US012203071B2

(12) United States Patent
Jagasia et al.

(10) Patent No.: US 12,203,071 B2
(45) Date of Patent: *Jan. 21, 2025

(54) OLIGONUCLEOTIDE AGONISTS TARGETING PROGRANULIN

(71) Applicant: Hoffmann-La Roche Inc., Little Falls, NJ (US)

(72) Inventors: Ravi Jagasia, Basel (CH); Lars Joenson, Hørsholm (DK); Søren Rasmussen, Hørsholm (DK); Disa Tehler, Hørsholm (DK); Dorthe Vang Larsen, Hørsholm (DK); Jesper Worm, Hørsholm (DK)

(73) Assignee: Hoffmann-La Roche Inc., Little Falls, NJ (US)

( * ) Notice: Subject to any disclaimer, the term of this patent is extended or adjusted under 35 U.S.C. 154(b) by 13 days.

This patent is subject to a terminal disclaimer.

(21) Appl. No.: 17/320,139

(22) Filed: May 13, 2021

(65) Prior Publication Data

US 2021/0388357 A1 Dec. 16, 2021

(30) Foreign Application Priority Data

May 13, 2020 (EP) ..................................... 20174322
Nov. 30, 2020 (EP) ..................................... 20210822

(51) Int. Cl.
C07H 21/04 (2006.01)
A61P 25/00 (2006.01)
C12N 15/113 (2010.01)

(52) U.S. Cl.
CPC ............ *C12N 15/113* (2013.01); *A61P 25/00* (2018.01); *C12N 2310/11* (2013.01); *C12N 2310/315* (2013.01); *C12N 2310/3231* (2013.01); *C12N 2310/3341* (2013.01)

(58) Field of Classification Search
None
See application file for complete search history.

(56) References Cited

U.S. PATENT DOCUMENTS

| | | | |
|---|---|---|---|
| 6,824,775 B2 | 11/2004 | Serrero | |
| 7,250,496 B2* | 7/2007 | Bentwich | G16B 15/10 435/320.1 |
| 7,655,785 B1* | 2/2010 | Bentwich | C12N 15/113 536/23.1 |
| 8,090,542 B2* | 1/2012 | Khvorova | C12Y 113/12007 435/6.1 |
| 9,486,541 B2* | 11/2016 | Hutton | C12Q 1/6809 |
| 10,323,236 B2* | 6/2019 | Liu | A61P 35/00 |
| 2005/0014711 A1* | 1/2005 | Nyce | A61K 45/06 514/44 A |
| 2007/0238687 A1* | 10/2007 | Bhanot | C07K 14/705 536/23.1 |
| 2015/0232836 A1* | 8/2015 | Krieg | A61P 35/02 530/358 |
| 2018/0087104 A1* | 3/2018 | Joung | C12Q 1/6855 |
| 2022/0204973 A1 | 6/2022 | Jagasia et al. | |

FOREIGN PATENT DOCUMENTS

| | | |
|---|---|---|
| TW | 202208628 A | 3/2022 |
| WO | 98/39352 A1 | 9/1998 |
| WO | 99/14226 A2 | 3/1999 |
| WO | 2000/047599 A1 | 8/2000 |
| WO | 00/66604 A2 | 11/2000 |
| WO | 01/23613 A1 | 4/2001 |
| WO | 2004/016160 A2 | 2/2004 |
| WO | 2004/046160 A2 | 6/2004 |
| WO | 2007/090071 A2 | 8/2007 |
| WO | 2007/134181 A2 | 11/2007 |
| WO | 2008/150729 A2 | 12/2008 |
| WO | 2008/154401 A2 | 12/2008 |
| WO | 2009/006478 A2 | 1/2009 |
| WO | 2009/067647 A1 | 5/2009 |
| WO | 2010/036698 A1 | 4/2010 |
| WO | 2010/077578 A1 | 7/2010 |
| WO | 2011/017521 A2 | 2/2011 |
| WO | 2011/156202 A1 | 12/2011 |
| WO | 2013/154798 A1 | 10/2013 |
| WO | 2013/173635 A1 | 11/2013 |
| WO | 2014/076195 A1 | 5/2014 |
| WO | 2015/113922 A1 | 8/2015 |
| WO | 2016/077837 A1 | 5/2016 |
| WO | 2019/001212 A1 | 1/2019 |
| WO | 2019/109051 A1 | 6/2019 |
| WO | 2020/077165 A1 | 4/2020 |
| WO | 2020/191212 A1 | 9/2020 |
| WO | 2021/229036 A1 | 11/2021 |

OTHER PUBLICATIONS

Kojima, Yoji, et al. "Progranulin expression in advanced human atherosclerotic plaque." Atherosclerosis 206.1 (2009): 102-108.*
Touznik et al. ("LNA/DNA mixmer-based antisense oligonucleotides correct alternative splicing of the SMN2 gene and restore SMN protein expression in type 1 SMA fibroblasts." Scientific reports 7.1 (2017): 1-9).*
Aggarwal, Geetika, et al. "Antisense oligonucleotides targeting the miR-29b binding site in the GRN mRNA increase progranulin translation." Journal of Biological Chemistry 299.12 (2023).*
Arechavaleta-Velsaco F et al., "Progranulin and its biological effects in cancer", Medical Oncology, Science and Technology Letters, vol. 34, Issue 12, Nov. 2017, pp. 1-11.
Bergstrom DE, "Unnatural nucleosides with unusual base pairing properties", Current Protocols in Nucleic Acid Chemistry, 2009, Suppl. 37 1.4.1, 32 pgs.
Deleavey, GF et al., "Designing Chemically Modified Oligonucleotides for Targeted Gene Silencing," Chemistry and Biology, 2012, vol. 19(8), pp. 937-954, 18 pages.

(Continued)

*Primary Examiner* — Kimberly Chong
(74) *Attorney, Agent, or Firm* — Smith, Gambrell & Russell, LLP; Judy Jarecki-Black; Sharon Ngwenya

(57) ABSTRACT

The present invention relates to oligonucleotides which up-regulate or restore the expression of progranulin in cells, and their use in the treatment of neurological disorders, and disorders associated with progranulin haploinsufficiency.

15 Claims, 10 Drawing Sheets

Specification includes a Sequence Listing.

(56) References Cited

OTHER PUBLICATIONS

Freier, S.M. et al., The ups and downs of nucleic acid duplex stability: structure-stability studies on chemically-modified DNA:RNA duplexes, Nucleic Acids Research, 1997, vol. 25(22), pp. 4429-4443.
Galimbertt D et al., "Progranulin as a therapeutic target for dementia", Expert Opinion on Therapeutic Targets, vol. 22, Issue 7, Jun. 22, 2018, pp. 579-585.
Hirao, I et al., "Natural versus Artificial Creation of Base Pairs in DNA: Origin of Nucleobases from the Perspectives of Unnatural Base Pair Studies," Accounts of Chemical Research, 2012, vol. 45, No. 12, pp. 2055-2065, 11 pages.
Holdgate G A et al., "Measurements of binding thermodynamics in drug discovery," Drug Discovery Today, vol. 10, Issue 22, 2005, pp. 1543-1550.
Manoharan, "Oligonucleotide Conjugates as Potential Antisense Drugs with Improved Uptake, Biodistribution, Targeted Delivery, and Mechanism of Action," Antisense and Nucleic Acid Drug Development, Jul. 8, 2004, 12(2):103-128.
Manoharan, M., "Oligonucleolide Conjugates in Antisense Technology," Antisense Drug Technology, Marcel Dekker, Inc., 2001, Ch. 16, pp. 391-469, 81 pages.
McTigue P M et al., "Sequence-dependent thermodynamic parameters for locked nucleic acid (LNA)-DNA duplex formation," Biochemistry, vol. 43, issue 18, 2004, pp. 5388-5405.
Mendsaikhan Anarmaa et al., "Microglial Progranulin: Involement in Alzheimer's Disease and Neurodegenerative Diseases," Cells, vol. 8, Issue 230, Mar. 11, 2019, pp. 1-25.
Mergny J L et al, "Analysis of thermal melting curves," Oligonucleotides, vol. 13, Issue 6, 2003, pp. 515-537.
Mitsuoka, Y et al., "A bridged nucleic acid, 2',4'-BNACOC: synthesis of fully modified oligonucleotides bearing thymine, 5-methylcytosine, adenine and guanine 2',4'-BNACOC monomers and RNA-selective nucleic-acid recognition," Nucleic Acids Research, 2009, vol. 37, No. 4, pp. 1225-1238, 14 pages.
Morita et al., "2'-O,4'-C-Ethylene-Bridged Nucleic Acids (ENA): Highly Nuclease-Resistant and Thermodynamically Stable Oligonucleotides for Antisense Drug," Bioorg Med Chem Lett. 12(1): 73-76 (2002) (4 pages).
Petkau T L et al., "Progranulin expression in the developing and adult murine brain," Journal of Comparative Neurology, vol. 518, Issue 19, 2010, pp. 3931-3947.
Santalucia, Jr., "A unified view of polymer, dumbbell, and oligonucleotide DNA nearest-neighbor thermodynamics," Proc Natl Acad Science USA, vol. 95, Feb. 1998, pp. 1460-1465.
Seth, PP et al., "Synthesis and Biophysical Evaluation of 2',4'-Constrained 2'O-Methoxyethyl and 2',4'-Constrained 2'O-Ethyl Nucleic Acid Analogues," J. Org. Chem., 2010, vol. 75:5, pp. 1569-1581.
Sugimoto N et al., "Thermodynamic Parameters To Predict Stability of RNA/DNA Hybrid Duplexes," Biochemistry, vol. 34, Issue 35, 1995, pp. 11211-11216.
Townley, et al, "Progranulin Functions and neurologic correlations", Neurology. Jan. 16, 2018; 90(3): 118-125. doi: 10.1212/WNL.0000000000004840.
Uhlmann E, "Recent advances in the medicinal chemistry of antisense olignonucleotides," Current Opinion in Drug Development, 2000, vol. 3(2), pp. 203-213, 12 pages.
WAN: The Medicinal Chemistry of Therapeutic Oligonucleotides, Journal of Medicinal Chemistry, 2016, 59, 9645-9667, 23 pgs.
Yang Jian et al., "Genome-Scale CRISPRa Screen Identifies Novel Factors for Cellular Reprogamming", Stem Cell Reports, vol. 12, Issue 4, Mar. 19, 2019, pp. 757-771.
Yang Jian et al., "Genome-Scale CRISPRa Screen Identifies Novel Factors for Cellular Reprogamming", Stem Cell Reports, Mar. 21, 2019, supplementary tables,.
Arechavaleta-Velsaco, F., et al., "Progranulin and its biological effects in cancer", Medical Oncology, Science and Technology Letters, vol. 34, No. 12, 2017, pp. pp. 1-11.
Bergstrom, D.E., "Unnatural nucleosides with unusual base pairing properties", Current Protocols in Nucleic Acid Chemistry, Suppl. vol. 37, No. 1.4, 2009, 13 pages.
Deleavey, G. F., et al., "Designing Chemically Modified Oligonucleotides for Targeted Gene Silencing", Chemistry and Biology, vol. 19, No. 8, 2012, pp. 937-954.
Freier, S. M., et al., "The ups and downs of nucleic acid duplex stability: structure-stability studies on chemically-modified DNA:RNA duplexes", Nucl. Acid Res., vol. 25, No. 22, 1997, pp. 4429-4443.
Galimbertt, D., et al., "Progranulin as a therapeutic target for dementia", Expert Opinion on Therapeutic Targets, vol. 22, No. 7, 2018, pp. 579-585.
Hansen, L. D., et al., "Entropy titration. A calorimetric method for the determination of ?G° (K), ?H° and ?S°", Chem. Comm., 1965, pp. 36-38.
Holdgate, G. A., et. al., "Measurements of binding thermodynamics in drug discovery", Drug Discov. Today, vol. 10, No. 22, 2005, pp. 1543-1550.
International Preliminary Report on Patentability received for PCT Patent Application No. PCT/EP2021/062785, mailed on Nov. 24, 2022, 13 pages.
International Preliminary Report on Patentability received for PCT/EP2021/062785 on Nov. 15, 2022, 12 Pages.
International Search Report & Written Opinion received for PCT/EP2021/062785 on Nov. 18, 2021, 19 Pages.
International Search Report and Written Opinion received for PCT Patent Application No. PCT/EP21/062785, mailed on Nov. 2, 2021, 19 pages.
Kojima, Y., et al., "Progranulin expression in advanced human atherosclerotic plaque", Atherosclerosis, vol. 206, No. 1, 2009, pp. 102-108.
Manoharan, M., "Oligonucleotide Conjugates as Potential Antisense Drugs with Improved Uptake, Biodistribution, Targeted Delivery, and Mechanism of Action", Antisense and Nucleic Acid Drug Development, vol. 12, 2002, pp. 103-128.
McTigue, P., et al., "Sequence-Dependent Thermodynamic Parameters for Locked Nucleic Acid (LNA)-DNA Duplex Formation", Biochemistry, vol. 43, No. 18, 2004, pp. 5388-5405.
Mendsaikhan, A., et al., "Microglial Progranulin: Involement in Alzheimer's Disease and Neurodegenerative Diseases", Cells, vol. 8, No. 2, 2019, 25 pages.
Mergny, J. L., et al., "Analysis of Thermal Melting Curves", Oligonucleotides, vol. 13, No. 6, 2003, pp. 515-537.
Mitsuoka, Y., et al., "A bridged nucleic acid, 2',4'-BNA COC : synthesis of fully modified oligonucleotides bearing thymine, 5-methylcytosine, adenine and guanine 2',4'-BNA COC monomers and RNA-selective nucleic-acid recognition", Nucleic Acids Research, vol. 37, No. 4, 2009, pp. 1225-1238.
Morita, K., et al., "2'-O,4'-C-ethylene-bridged nucleic acids (ENA): highly nuclease-resistant and thermodynamically stable oligonucleotides for antisense drug", Bioorganic & Med.Chem. Lett., vol. 12, No. 1, 2002, pp. 73-76.
Petkau, T. L., et al., "Progranulin Expression in the Developing Adult Murine Brain", The J. of Comp. Neurology, vol. 518, 2010, pp. 3931-3947.
Santalucia, J., "A unified view of polymer, dumbbell, and oligonucleotide DNA nearest-neighbor?thermodynamics", Proc. Natl. Acad. Sci., USA, vol. 95, 1998, pp. 1460-1465.
Seth, P.P., et al., "Synthesis and Biophysical Evaluation of 2',4'-Constrained 2'O-Methoxyethyl and 2',4'-Constrained 2'O-Ethyl Nucleic Acid Analogues", J. Org. Chem., vol. 75, No. 5, 2010, pp. 1569-1581.
Townley, R. A., et al., "Progranulin Functions and neurologic correlations", Neurology, vol. 90, No. 24, 2018, pp. 118-125.
Uhlmann, E., "Recent advances in the medicinal chemistry of antisense oligonucleotides", Curr. Opinion in Drug Development, vol. 3, No. 2, 2000, pp. 203-213.
Wan, W. B., et al., "The Medicinal Chemistry of Therapeutic Oligonucleotides", Medical Chemistry, vol. 59, No. 21, 2016, pp. 9645-9667.
Yang, J. et al., Supplementary table S5 to: Genome-Scale CRISPRa Screen Identifies Novel Factors for Cellular Reprogramming, Stem Cell Reports, 2019.

(56) References Cited

OTHER PUBLICATIONS

Yang, J., et al., "Genome-Scale CRISPRa Screen Identifies Novel Factors for Cellular Reprogamming", Stem Cell Reports, vol. 12, No. 4, 2019, pp. 757-771.

* cited by examiner

Figure 2

```
5'  TAAGTAGCCAATGGGAGCG-GGTAGCCCTGATCCCTGGCCAATGGAAACTGAGGTAGG  3'
Mouse CAAGTAACCAATGGAAGCCCTGGATCTCCGAGCAATGGCTAATGGAAATTGAGGTGGG
Human TAAGTAGCCAATGGGAGCG-GGTAGCCCTGATCCCTGGCCAATGGAAACTGAGGTAGG
Cyno  TAAGTAGCCAATGGAGTGCCGGCAGCCCTGATCCCTGGCCAATGGAAACTGAGGTAGG
```

Compound #114
Compound #110
Compound #105
Compound #106

OLIGONUCLEOTIDE AGONISTS TARGETING PROGRANULIN

CROSS REFERENCE TO RELATED APPLICATIONS

This application is a direct national of and claims priority to European Patent Application No. 20174322.6 filed May 13, 2020, and to European Patent Application No. 20210822.1 filed Nov. 30, 2020, the entire disclosures of which are incorporated herein by this reference.

REFERENCE TO A SEQUENCE LISTING SUBMITTED VIA EFS-WEB

The content of the ASCII text file of the sequence listing named "Hoffmann-La Roche Inc. updated sequence listing 06022021" which was created on Jun. 11, 2021, and is 799.722 bytes in size submitted electronically via EFS-Web with this U.S. application is incorporated by reference in its entirety.

FIELD OF INVENTION

The present invention relates to oligonucleotides which up-regulate or restore the expression of progranulin in cells, and their use in the treatment of neurological disorders, and disorders associated with progranulin haploinsufficiency.

BACKGROUND

Progranulin (PGRN) is a highly conserved secreted protein that is expressed in multiple cell types, both in the CNS and in peripheral tissues.

Deficiency of the secreted protein progranulin in the central nervous system causes the neurodegenerative disease fronto temporal dementia (FTD). Pathogenic progranulin (GRN) mutations lead to a loss of about 50% in progranulin levels through haploinsufficiency and to intraneuronal aggregation of TDP-43 protein. Progranulin plays a supportive and protective role in numerous processes within the brain, including neurite outgrowth, synapse biology, response to exogenous stressors, lysosomal function, neuroinflammation, and angiogenesis in both cell autonomous and non-autonomous manners.

In several neurodegenerative diseases TDP-43 is a common denominator. TDP-43 pathology is associated with cytoplasmic TDP-43 aggregation. For example, more than 95% of ALS patients display pathological mislocalization of TDP-43 and several mutations in its gene cause familial ALS.

The presence of cytoplasmic TDP-43 aggregates is associated with a concomitant loss of nuclear TDP-43, and there is evidence of both loss of function and gain of function associated pathophysiologies.

Both directly and via its conversion to granulins, progranulin regulates lysosomal function, cell growth, survival, repair, and inflammation. Progranulin has a major role in regulation of lysosomal function associated microglial responses in the CNS. Autosomal dominant mutations of the progranulin (GRN) gene leading to protein haploinsufficiency are linked to familial frontotemporal dementia with neuropathologic frontotemporal lobar degeneration (FTLD) associated with accumulation of TAR-DNA binding protein of 43 kDA (TDP-43) inclusions (FTLD-TDP). Homozygous GRN mutations are linked to neuronal ceroid lipofuscinosis (NCL) (Townley, et al., Neurology. 2018 Jun. 12; 90 (24): 1127).

Mutations in the progranulin gene (GRN) have recently been identified as a cause of about 5% of all FTD, including some sporadic cases. Recent studies using mouse models has defined the expression of PGRN in the brain (Petkau et al., 2010). PGRN is expressed late in neurodevelopment, localizing with markers of mature neurons. PGRN is expressed in neurons in most brain regions, with highest expression in the thalamus, hippocampus, and cortex. Microglia cells also express progranulin, and the level of expression is upregulated by microglial activation. Around 70 different GRN mutations have been identified in FTD and all reduce progranulin levels or result in loss of progranulin function.

WO 2020/077165 reports on AAV particle delivery of therapeutic nucleic acids, and lists progranulin as a potential gene of interest.

There is therefore an urgent need for therapeutic agents which can increase the expression of progranulin.

SUMMARY OF INVENTION

The invention provides antisense oligonucleotide agonists of progranulin or antisense oligonucleotide progranulin agonists—i.e. antisense oligonucleotides which are complementary to a progranulin nucleic acid sequence, and which are capable of up-regulating the expression of progranulin. Alternatively stated, the invention provides antisense oligonucleotide positive modulators (i.e. agonists) of progranulin.

The antisense oligonucleotides of the invention may therefore be used to restore progranulin expression in cells which exhibit progranulin haploinsufficiency, or to enhance expression of progranulin in cells.

The invention provides an antisense oligonucleotide progranulin agonist, wherein the antisense oligonucleotide is 8-40 nucleotides in length and comprises a contiguous nucleotide sequence of 8-40 nucleotides in length which are complementary, such as fully complementary, to a human progranulin precursor-mRNA (pre-mRNA) or mature mRNA transcript.

The invention provides an antisense oligonucleotide progranulin agonist, wherein the antisense oligonucleotide is 12-40 nucleotides in length and comprises a contiguous nucleotide sequence of 12-40 nucleotides in length which are complementary, such as fully complementary, to a human progranulin precursor-mRNA (pre-mRNA) or mature mRNA transcript.

The invention provides an antisense oligonucleotide progranulin agonist, wherein the antisense oligonucleotide is 12-20 nucleotides in length and comprises a contiguous nucleotide sequence of 12-20 nucleotides in length which are complementary, such as fully complementary, to a human progranulin precursor-mRNA (pre-mRNA) or mature mRNA transcript.

The invention provides an antisense oligonucleotide progranulin agonist, wherein the antisense oligonucleotide is 14-18 nucleotides in length and comprises a contiguous nucleotide sequence of 14-18 nucleotides in length which are complementary, such as fully complementary, to a human progranulin precursor-mRNA (pre-mRNA) or mature mRNA transcript.

The invention provides an antisense oligonucleotide progranulin agonist, wherein the antisense oligonucleotide is 12-18 nucleotides in length and comprises a contiguous nucleotide sequence of 12-18 nucleotides in length which are complementary, such as fully complementary, to a human progranulin precursor-mRNA (pre-mRNA) or mature mRNA transcript.

The invention provides an antisense oligonucleotide progranulin agonist, wherein the antisense oligonucleotide is 8-40 nucleotides in length and comprises a contiguous nucleotide sequence of 8-40 nucleotides in length which are complementary, such as fully complementary, to SEQ ID NO 2 or 689.

The invention provides an antisense oligonucleotide progranulin agonist, wherein the antisense oligonucleotide is 12-40 nucleotides in length and comprises a contiguous nucleotide sequence of 12-40 nucleotides in length which are complementary, such as fully complementary, to SEQ ID NO 2 or 689.

The invention provides an antisense oligonucleotide progranulin agonist, wherein the antisense oligonucleotide is 12-20 nucleotides in length and comprises a contiguous nucleotide sequence of 12-20 nucleotides in length which are complementary, such as fully complementary, to SEQ ID NO 2 or 689.

The invention provides an antisense oligonucleotide progranulin agonist, wherein the antisense oligonucleotide is 14-18 nucleotides in length and comprises a contiguous nucleotide sequence of 14-18 nucleotides in length which are complementary, such as fully complementary, to SEQ ID NO 2 or 689.

The invention provides an antisense oligonucleotide progranulin agonist, wherein the antisense oligonucleotide is 12-18 nucleotides in length and comprises a contiguous nucleotide sequence of 12-18 nucleotides in length which are complementary, such as fully complementary, to SEQ ID NO 2 or 689.

The invention provides an antisense oligonucleotide progranulin agonist, wherein the antisense oligonucleotide is 8-40 nucleotides in length and comprises a contiguous nucleotide sequence of 8-40 nucleotides in length which are complementary, such as fully complementary, to a sequence selected from the group consisting of SEQ ID NO 683, 684, 685, 686, 687 and 688.

The invention provides an antisense oligonucleotide progranulin agonist, wherein the antisense oligonucleotide is 12-40 nucleotides in length and comprises a contiguous nucleotide sequence of 12-40 nucleotides in length which are complementary, such as fully complementary, to a sequence selected from the group consisting of SEQ ID NO 683, 684, 685, 686, 687 and 688.

The invention provides an antisense oligonucleotide progranulin agonist, wherein the antisense oligonucleotide is 12-20 nucleotides in length and comprises a contiguous nucleotide sequence of 12-20 nucleotides in length which are complementary, such as fully complementary, to a sequence selected from the group consisting of SEQ ID NO 683, 684, 685, 686, 687 and 688.

The invention provides an antisense oligonucleotide progranulin agonist, wherein the antisense oligonucleotide is 14-18 nucleotides in length and comprises a contiguous nucleotide sequence of 14-18 nucleotides in length which are complementary, such as fully complementary, to a to a sequence selected from the group consisting of SEQ ID NO 683, 684, 685, 686, 687 and 688.

The invention provides an antisense oligonucleotide progranulin agonist, wherein the antisense oligonucleotide is 12-18 nucleotides in length and comprises a contiguous nucleotide sequence of 12-18 nucleotides in length which are complementary, such as fully complementary, to a sequence selected from the group consisting of SEQ ID NO 683, 684, 685, 686, 687 and 688.

The antisense oligonucleotide progranulin agonist may be 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 nucleotides in length. In some embodiments the antisense oligonucleotide, or contiguous nucleotide sequence thereof, is 8-40, 12-40, 12-20, 14-18, 12-18 or 16-18 nucleotides in length.

The contiguous nucleotide sequence may be 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 nucleotides in length. In some embodiments, the contiguous nucleotide sequence is of a length of at least 12 nucleotides in length, such as 12-16 or 12-18 nucleotides in length.

In some embodiments, the contiguous nucleotide sequence is the same length as the antisense oligonucleotide progranulin agonist.

In some embodiments the antisense oligonucleotide consists of the contiguous nucleotide sequence.

In some embodiments the antisense oligonucleotide is the contiguous nucleotide sequence.

In some embodiments, the contiguous nucleotide sequence is fully complementary to a sequence selected from the group consisting of SEQ ID NO 343-682.

In some embodiments the contiguous nucleotide sequence is complementary, such as fully complementary, to the human progranulin mature mRNA (SEQ ID NO: 1).

In some embodiments the contiguous nucleotide sequence is complementary, such as fully complementary, to the human progranulin precursor-mRNA (pre-mRNA) (SEQ ID NO: 3949).

In some embodiments, the contiguous nucleotide sequence is complementary, such as fully complementary, to a 5'UTR region of a human progranulin mature mRNA transcript. Herein the 5' UTR is defined as nucleotides 38 to 241 according to RefSeq NM_002807.3 (SEQ ID NO 1).

In some embodiments, the contiguous nucleotide sequence is complementary, such as fully complementary, to nucleotides 38-246 of SEQ ID NO 1.

In some embodiments, the contiguous nucleotide sequence is complementary, such as fully complementary, to SEQ ID NO 689.

In some embodiments, the contiguous nucleotide sequence is complementary, such as fully complementary, to SEQ ID NO 2.

In some embodiments, the contiguous nucleotide sequence is complementary, such as fully complementary, to SEQ ID NO 683.

In some embodiments, the contiguous nucleotide sequence is complementary, such as fully complementary, to a sequence selected from the group consisting of SEQ ID NO 343-586.

In some embodiments, the contiguous nucleotide sequence is complementary, such as fully complementary, to a sequence selected from the group consisting of SEQ ID NO 568, SEQ ID NO 571, SEQ ID NO 575, SEQ ID NO 576, SEQ ID NO 577, SEQ ID NO 578, SEQ ID NO 584, & SEQ ID NO 586.

In some embodiments, the contiguous nucleotide sequence is a sequence selected from the group consisting of SEQ ID NO 3-342, or at least 8 contiguous nucleotides thereof.

In some embodiments, the contiguous nucleotide sequence is a sequence selected from the group consisting of SEQ ID NO 3-342, or at least 9 contiguous nucleotides thereof.

In some embodiments, the contiguous nucleotide sequence is a sequence selected from the group consisting of SEQ ID NO 3-342, or at least 10 contiguous nucleotides thereof.

In some embodiments, the contiguous nucleotide sequence is a sequence selected from the group consisting of SEQ ID NO 3-342, or at least 11 contiguous nucleotides thereof.

In some embodiments, the contiguous nucleotide sequence is a sequence selected from the group consisting of SEQ ID NO 3-342, or at least 12 contiguous nucleotides thereof.

In some embodiments, the contiguous nucleotide sequence is a sequence selected from the group consisting of SEQ ID NO 3-342, or at least 13 contiguous nucleotides thereof.

In some embodiments, the contiguous nucleotide sequence is a sequence selected from the group consisting of SEQ ID NO 3-342, or at least 14 contiguous nucleotides thereof.

In some embodiments, the contiguous nucleotide sequence is a sequence selected from the group consisting of SEQ ID NO 3-342, or at least 15 contiguous nucleotides thereof.

In some embodiments, the contiguous nucleotide sequence is a sequence selected from the group consisting of SEQ ID NO 3-342, or at least 16 contiguous nucleotides thereof.

In some embodiments, the contiguous nucleotide sequence is selected from SEQ ID NO 105, SEQ ID NO 106, SEQ ID NO 110, SEQ ID NO 113, SEQ ID NO 114, SEQ ID NO 231 and SEQ ID NO 241 or at least 8 or at least 10 contiguous nucleotides thereof.

In some embodiments the contiguous nucleotide sequence is SEQ ID NO 106.

In some embodiments the contiguous nucleotide sequence is SEQ ID NO 110.

In some embodiments, the contiguous nucleotide sequence is complementary, such as fully complementary, to a 3'UTR region of a human progranulin mature mRNA transcript. Herein the 3' UTR is defined as nucleotides 2044 to 2346 according to RefSeq NM_002807.3 (SEQ ID NO 1).

In some embodiments, the contiguous nucleotide sequence is complementary, such as fully complementary, to nucleotides 2039-2346 of SEQ ID NO 1.

In some embodiments, the contiguous nucleotide sequence is complementary, such as fully complementary, to a sequence selected from the group consisting of SEQ ID NO 684, SEQ ID NO 685, SEQ ID NO 686, SEQ ID NO 687, and SEQ ID NO 688.

In some embodiments, the contiguous nucleotide sequence is complementary, such as fully complementary, to a sequence selected from the group consisting of SEQ ID NO 587-682.

In some embodiments, the contiguous nucleotide sequence is complementary, such as fully complementary, to a sequence selected from the group consisting of SEQ ID NO 607, SEQ ID NO 608, SEQ ID NO 609, SEQ ID NO 610, SEQ ID NO 611, SEQ ID NO 612, SEQ ID NO 619, SEQ ID NO 620, SEQ ID NO 633, SEQ ID NO 640, SEQ ID NO 641, SEQ ID NO 645, SEQ ID NO 651, and SEQ ID NO 652.

In some embodiments, the contiguous nucleotide sequence is complementary, such as fully complementary, to a sequence selected from the group consisting of SEQ ID NO 2040-3386.

In some embodiments, the contiguous nucleotide sequence is complementary, such as fully complementary, to a sequence selected from the group consisting of SEQ ID NO 2040-3386 or at least 8 contiguous nucleotides thereof.

In some embodiments, the contiguous nucleotide sequence is complementary, such as fully complementary, to a sequence selected from the group consisting of SEQ ID NO 2040-3386 or at least 9 contiguous nucleotides thereof.

In some embodiments, the contiguous nucleotide sequence is complementary, such as fully complementary, to a sequence selected from the group consisting of SEQ ID NO 2040-3386 or at least 10 contiguous nucleotides thereof.

In some embodiments, the contiguous nucleotide sequence is complementary, such as fully complementary, to a sequence selected from the group consisting of SEQ ID NO 2040-3386 or at least 11 contiguous nucleotides thereof.

In some embodiments, the contiguous nucleotide sequence is complementary, such as fully complementary, to a sequence selected from the group consisting of SEQ ID NO 2040-3386 or at least 12 contiguous nucleotides thereof.

In some embodiments, the contiguous nucleotide sequence is complementary, such as fully complementary, to a sequence selected from the group consisting of SEQ ID NO 2040-3386 or at least 13 contiguous nucleotides thereof.

In some embodiments, the contiguous nucleotide sequence is complementary, such as fully complementary, to a sequence selected from the group consisting of SEQ ID NO 2040-3386 or at least 14 contiguous nucleotides thereof.

In some embodiments, the contiguous nucleotide sequence is complementary, such as fully complementary, to a sequence selected from the group consisting of SEQ ID NO 2040-3386 or at least 15 contiguous nucleotides thereof.

In some embodiments, the contiguous nucleotide sequence is complementary, such as fully complementary, to a sequence selected from the group consisting of SEQ ID NO 2040-3386 or at least 16 contiguous nucleotides thereof.

In some embodiments, the contiguous nucleotide sequence is complementary, such as fully complementary, to a sequence selected from the group consisting of SEQ ID 2321, SEQ ID 2322, SEQ ID 2324, SEQ ID 2328, SEQ ID 2329, SEQ ID 2331, SEQ ID 2334, SEQ ID 2335, SEQ ID 2336, SEQ ID 2337, SEQ ID 2338, SEQ ID 2339, SEQ ID 2340, SEQ ID 2341, SEQ ID 2342, SEQ ID 2345, SEQ ID 2346, SEQ ID 2347, SEQ ID 2348, SEQ ID 2349, SEQ ID 2350, SEQ ID 2351, SEQ ID 2352, SEQ ID 2353, SEQ ID 2354, SEQ ID 2355, SEQ ID 2356, SEQ ID 2357, SEQ ID 2358, SEQ ID 2359, SEQ ID 2360, SEQ ID 2361, SEQ ID 2362, SEQ ID 2364, SEQ ID 2365, SEQ ID 2366, SEQ ID 2367, SEQ ID 2368, SEQ ID 2369, SEQ ID 2370, SEQ ID 2371, SEQ ID 2372, SEQ ID 2373, SEQ ID 2374, SEQ ID 2375, SEQ ID 2376, SEQ ID 2377, SEQ ID 2378, SEQ ID 2379, SEQ ID 2380, SEQ ID 2381, SEQ ID 2384, SEQ ID 2386, SEQ ID 2387, SEQ ID 2388, SEQ ID 2389, SEQ ID 2390, SEQ ID 2392, SEQ ID 2393, SEQ ID 2394, SEQ ID 2395, SEQ ID 2396, SEQ ID 2397, SEQ ID 2398, SEQ ID 2399, SEQ ID 2400, SEQ ID 2401, SEQ ID 2403, SEQ ID 2404, SEQ ID 2405, SEQ ID 2406, SEQ ID 2407, SEQ ID 2408, SEQ ID 2410, SEQ ID 2411, SEQ ID 2413, SEQ ID 2414, SEQ ID 2415, SEQ ID 2416, SEQ ID 2418, SEQ ID 2419, SEQ ID 2421, SEQ ID 2424, SEQ ID 2425, SEQ ID 2426, SEQ ID 2427, SEQ ID 2428, SEQ ID 2429, SEQ ID 2430, SEQ ID 2431, SEQ ID 2432, SEQ ID 2433, SEQ ID 2434, SEQ ID 2435, SEQ ID 2436, SEQ ID 2437, SEQ ID 2438, SEQ ID 2439, SEQ ID 2440, SEQ ID 2441, SEQ ID 2442, SEQ ID 2443, SEQ ID 2444, SEQ ID 2445, SEQ ID 2446, SEQ ID 2447, SEQ ID 2448, SEQ ID 2449, SEQ ID 2450, SEQ ID 2451, SEQ ID 2452, SEQ ID 2453, SEQ ID 2454, SEQ ID 2455, SEQ ID 2456, SEQ ID 2457, SEQ ID 2458, SEQ ID 2459, SEQ ID 2460, SEQ ID 2461, SEQ ID 2462, SEQ ID 2463, SEQ ID 2464, SEQ ID 2465, SEQ ID 2466, SEQ ID 2467, SEQ ID 2468, SEQ ID 2469, SEQ ID 2470, SEQ ID 2471, SEQ ID 2472, SEQ ID 2473, SEQ ID 2474, SEQ ID 2475, SEQ ID 2476, SEQ ID 2477, SEQ ID 2478, SEQ ID 2479, SEQ ID 2481, SEQ ID 2482, SEQ ID 2483, SEQ ID 2484, SEQ ID 2485, SEQ ID 2487, SEQ ID 2489, SEQ ID 2490, SEQ ID 2491, SEQ ID 2492, SEQ ID 2493, SEQ ID 2494, SEQ ID 2495, SEQ ID 2496, SEQ ID 2497, SEQ ID 2498, SEQ ID 2499, SEQ ID 2501, SEQ ID 2502, SEQ ID 2503, SEQ ID 2504, SEQ ID 2505, SEQ ID 2506, SEQ ID 2507, SEQ ID 2508, SEQ ID 2509, SEQ ID 2510, SEQ ID 2511, SEQ ID 2512, SEQ ID 2513, SEQ ID 2514, SEQ ID 2515, SEQ ID 2516, SEQ ID 2518, SEQ ID 2519, SEQ ID 2520, SEQ ID 2521, SEQ ID 2522, SEQ ID 2523, SEQ ID 2524, SEQ ID 2525, SEQ ID 2526, SEQ ID 2527, SEQ ID 2528, SEQ ID 2531, SEQ ID 2533, SEQ ID 2534, SEQ ID 2535, SEQ ID 2536, SEQ ID 2537, SEQ ID 2538, SEQ ID 2540, SEQ ID 2541, SEQ ID 2542, SEQ ID 2544, SEQ ID 2546, SEQ ID 2547, SEQ ID 2549, SEQ ID 2550, SEQ ID 2551, SEQ ID 2553, SEQ ID 2554, SEQ ID 2555, SEQ ID 2556, SEQ ID 2557, SEQ ID 2560, SEQ ID 2561, SEQ ID 2562, SEQ ID 2563, SEQ ID 2565, SEQ ID 2566, SEQ ID 2567, SEQ ID 2572, SEQ ID 2573, SEQ ID 2574, SEQ ID 2575, SEQ ID 2576, SEQ ID 2577, SEQ ID 2578, SEQ ID 2579, SEQ ID 2580, SEQ ID 2581, SEQ ID 2582, SEQ ID 2583, SEQ ID 2584, SEQ ID 2585, SEQ ID 2586, SEQ ID 2588, SEQ ID 2589, SEQ ID 2590, SEQ ID 2591, SEQ ID 2592, SEQ ID 2593, SEQ ID 2594, SEQ ID 2595, SEQ ID 2596, SEQ ID 2597, SEQ ID 2598, SEQ ID 2599, SEQ ID 2601, SEQ ID 2602, SEQ ID 2603, SEQ ID 2604, SEQ ID 2606, SEQ ID 2610, SEQ ID 2613, SEQ ID 2614, SEQ ID 2615, SEQ ID 2619, SEQ ID 2622, SEQ ID 2623, SEQ ID 2624, SEQ ID 2625, SEQ ID 2626, SEQ ID 2627, SEQ ID 2628, SEQ ID 2629, SEQ ID 2630, SEQ ID 2631, SEQ ID 2632, SEQ ID 2633, SEQ ID 2634, SEQ ID 2635, SEQ ID 2636, SEQ ID 2637, SEQ ID 2638, SEQ ID 2639, SEQ ID 2640, SEQ ID 2641, SEQ ID 2642, SEQ ID 2643, SEQ ID 2644, SEQ ID 2645, SEQ ID 2646, SEQ ID 2647, SEQ ID 2648, SEQ ID 2649, SEQ ID 2650, SEQ ID 2651, SEQ ID 2652, SEQ ID 2653, SEQ ID 2654, SEQ ID 2655, SEQ ID 2656, SEQ ID 2658, SEQ ID 2659, SEQ ID 2660, SEQ ID 2661, SEQ ID 2662, SEQ ID 2663, SEQ ID 2664, SEQ ID 2665, SEQ ID 2666, SEQ ID 2667, SEQ ID 2668, SEQ ID 2669, SEQ ID 2670, SEQ ID 2671, SEQ ID 2672, SEQ ID 2673, SEQ ID 2674, SEQ ID 2675, SEQ ID 2676, SEQ ID 2677, SEQ ID 2678, SEQ ID 2679, SEQ ID 2680, SEQ ID 2681, SEQ ID 2682, SEQ ID 2683, SEQ ID 2684, SEQ ID 2685, SEQ ID 2686, SEQ ID 2687, SEQ ID 2688, SEQ ID 2689, SEQ ID 2690, SEQ ID 2691, SEQ ID 2693, SEQ ID 2694, SEQ ID 2695, SEQ ID 2696, SEQ ID 2697, SEQ ID 2698, SEQ ID 2699, SEQ ID 2700, SEQ ID 2701, SEQ ID 2702, SEQ ID 2703, SEQ ID 2704, SEQ ID 2705, SEQ ID 2706, SEQ ID 2707, SEQ ID 2708, SEQ ID 2709, SEQ ID 2710, SEQ ID 2711, SEQ ID 2712, SEQ ID 2713, SEQ ID 2714, SEQ ID 2715, SEQ ID 2716, SEQ ID 2717, SEQ ID 2718, SEQ ID 2719, SEQ ID 2720, SEQ ID 2721, SEQ ID 2722, SEQ ID 2723, SEQ ID 2726, SEQ ID 2727, SEQ ID 2728, SEQ ID 2729, SEQ ID 2730, SEQ ID 2733, SEQ ID 2734, SEQ ID 2735, SEQ ID 2736, SEQ ID 2737, SEQ ID 2738, SEQ ID 2739, SEQ ID 2740, SEQ ID 2741, SEQ ID 2742, SEQ ID 2743, SEQ ID 2744, SEQ ID 2745, SEQ ID 2746, SEQ ID 2747, SEQ ID 2748, SEQ ID 2749, SEQ ID 2750, SEQ ID 2751, SEQ ID 2752, SEQ ID 2753, SEQ ID 2754, SEQ ID 2755, SEQ ID 2756, SEQ ID 2757, SEQ ID 2758, SEQ ID 2759, SEQ ID 2760, SEQ ID 2761, SEQ ID 2762, SEQ ID 2763, SEQ ID 2764, SEQ ID 2765, SEQ ID 2766, SEQ ID 2767, SEQ ID 2768, SEQ ID 2769, SEQ ID 2770, SEQ ID 2771, SEQ ID 2772, SEQ ID 2773, SEQ ID 2774, SEQ ID 2775, SEQ ID 2815, SEQ ID 2816, SEQ ID 2817, SEQ ID 2818, SEQ ID 2819, SEQ ID 2820, SEQ ID 2821, SEQ ID 2822, SEQ ID 2823, SEQ ID 2824, SEQ ID 2825, SEQ ID 2826, SEQ ID 2827, SEQ ID 2828, SEQ ID 2829, SEQ ID 2830, SEQ ID 2831, SEQ ID 2832, SEQ ID 2833, SEQ ID 2834, SEQ ID 2835, SEQ ID 2836, SEQ ID 2837, SEQ ID 2838, SEQ ID 2839, SEQ ID 2840, SEQ ID 2841, SEQ ID 2842, SEQ ID 2843, SEQ ID 2844, SEQ ID 2845, SEQ ID 2847, SEQ ID 2848, SEQ ID 2849, SEQ ID 2850, SEQ ID 2851, SEQ ID 2852, SEQ ID 2853, SEQ ID 2854, SEQ ID 2855, SEQ ID 2858, SEQ ID 2859, SEQ ID 2860, SEQ ID 2861, SEQ ID 2862, SEQ ID 2863, SEQ ID 2864, SEQ ID 2865, SEQ ID 2866, SEQ ID 2867, SEQ ID 2868, SEQ ID 2869, SEQ ID 2870, SEQ ID 2871, SEQ ID 2872, SEQ ID 2873, SEQ ID 2874, SEQ ID 2875, SEQ ID 2876, SEQ ID 2878, SEQ ID 2879, SEQ ID 2880, SEQ ID 2881, SEQ ID 2882, SEQ ID 2883, SEQ ID 2884, SEQ ID 2885, SEQ ID 2886, SEQ ID 2887, SEQ ID 2888, SEQ ID 2889, SEQ ID 2890, SEQ ID 2891, SEQ ID 2892, SEQ ID 2893, SEQ ID 2894, SEQ ID 2895, SEQ ID 2896, SEQ ID 2897, SEQ ID 2898, SEQ ID 2899, SEQ ID 2900, SEQ ID 2901, SEQ ID 2902, SEQ ID 2903, SEQ ID 2904, SEQ ID 2905, SEQ ID 2906, SEQ ID 2907, SEQ ID 2908, SEQ ID 2909, SEQ ID 2910, SEQ ID 2911, SEQ ID 2912, SEQ ID 2913, SEQ ID 2914, SEQ ID 2915, SEQ ID 2916, SEQ ID 2917, SEQ ID 2918, SEQ ID 2919, SEQ ID 2920, SEQ ID 2921, SEQ ID 2922, SEQ ID 2923, SEQ ID 2924, SEQ ID 2925, SEQ ID 2926, SEQ ID 2927, SEQ ID 2928, SEQ ID 2929, SEQ ID 2930, SEQ ID 2931, SEQ ID 2932, SEQ ID 2934, SEQ ID 2935, SEQ ID 2936, SEQ ID 2937, SEQ ID 2938, SEQ ID 2939, SEQ ID 2940, SEQ ID 2941, SEQ ID 2942, SEQ ID 2943, SEQ ID 2944, SEQ ID 2945, SEQ ID 2946, SEQ ID 2947, SEQ ID 2948, SEQ ID 2949, SEQ ID 2950, SEQ ID 2951, SEQ ID 2953, SEQ ID 2954, SEQ ID 2955, SEQ ID 2956, SEQ ID 2957, SEQ ID 2958, SEQ ID 2960, SEQ ID 2961, SEQ ID 2963, SEQ ID 2964, SEQ ID 2965, SEQ ID 2966, SEQ ID 2967, SEQ ID 2969, SEQ ID 2970, SEQ ID 2971, SEQ ID 2972, SEQ ID 2973, SEQ ID 2974, SEQ ID 2975, SEQ ID 2976, SEQ ID 2977, SEQ ID 2978, SEQ ID 2979, SEQ ID 2980, SEQ ID 2981, SEQ ID 2982, SEQ ID 2983, SEQ ID 2984, SEQ ID 2985, SEQ ID 3053, SEQ ID 3054, SEQ ID 3055, SEQ ID 3056, SEQ ID 3057, SEQ ID 3058, SEQ ID 3059, SEQ ID 3060, SEQ ID 3061, SEQ ID 3062, SEQ ID 3063, SEQ ID 3064, SEQ ID 3065, SEQ ID 3066, SEQ ID 3068, SEQ ID 3069, SEQ ID 3070, SEQ ID 3071, SEQ ID 3072, SEQ ID 3073, SEQ ID 3074, SEQ ID 3075, SEQ ID 3076, SEQ ID 3077, SEQ ID 3078, SEQ ID 3079, SEQ ID 3080, SEQ ID 3081, SEQ ID 3082, SEQ ID 3083, SEQ ID 3084, SEQ ID 3085, SEQ ID 3086, SEQ ID 3087, SEQ ID 3088, SEQ ID 3089, SEQ ID 3090, SEQ ID 3091, SEQ ID 3092, SEQ ID 3093, SEQ ID 3094, SEQ ID 3095, SEQ ID 3097, SEQ ID 3098, SEQ ID 3099, SEQ ID 3100, SEQ ID 3102, SEQ ID 3103, SEQ ID 3104, SEQ ID 3105, SEQ ID 3106, SEQ ID 3107, SEQ ID 3108, SEQ ID 3109, SEQ ID 3110, SEQ ID 3112, SEQ ID 3113, SEQ ID 3115, SEQ ID 3116, SEQ ID 3117, SEQ ID 3119, SEQ ID 3120, SEQ ID 3121, SEQ ID 3122, SEQ ID 3123, SEQ ID 3124, SEQ ID 3125, SEQ ID 3126, SEQ ID 3127, SEQ ID 3128, SEQ ID 3129, SEQ ID 3130, SEQ ID 3131, SEQ ID 3132, SEQ ID 3133, SEQ ID 3134, SEQ ID 3135, SEQ ID 3136, SEQ ID 3137, SEQ ID 3138, SEQ ID 3139, SEQ ID 3140, SEQ ID 3141, SEQ ID 3142, SEQ ID 3143, SEQ ID 3144, SEQ ID 3145, SEQ ID 3146, SEQ ID 3147, SEQ ID 3148, SEQ ID 3149, SEQ ID SEQ ID 3150, SEQ ID 3151, SEQ ID 3152, SEQ ID 3153, SEQ ID 3154, SEQ ID 3155, SEQ ID 3156, SEQ ID 3157, SEQ ID 3158, SEQ ID 3159, SEQ ID 3160, SEQ ID 3161, SEQ ID 3162, SEQ ID 3163, SEQ ID 3164, SEQ ID 3165, SEQ ID 3166, SEQ ID 3167, SEQ ID 3168, SEQ ID 3169, SEQ ID 3170, SEQ ID 3171, SEQ ID 3172, SEQ ID 3173, SEQ ID 3174, SEQ ID 3175, SEQ ID 3176, SEQ ID 3177, SEQ ID 3178, SEQ ID 3179, SEQ ID 3180, SEQ ID 3181, SEQ ID 3182, SEQ ID 3183, SEQ ID 3184, SEQ ID 3185, SEQ ID 3186, SEQ ID 3187, SEQ ID 3188, SEQ ID 3189, SEQ ID 3190, SEQ ID 3191, SEQ ID 3192, SEQ ID 3193, SEQ ID 3194, SEQ ID 3195, SEQ ID 3196, SEQ ID 3197, SEQ ID 3198, SEQ ID 3199, SEQ ID 3200, SEQ ID 3201, SEQ ID 3202, SEQ ID 3203, SEQ ID 3204, SEQ ID 3205, SEQ ID 3206, SEQ ID 3207, SEQ ID 3208, SEQ ID 3209, SEQ ID 3210, SEQ ID 3211, SEQ ID 3212, SEQ ID 3213, SEQ ID 3214, SEQ ID 3215, SEQ ID 3216, SEQ ID 3217, SEQ ID 3218, SEQ ID 3219, SEQ ID 3220, SEQ ID 3221, SEQ ID 3222, SEQ ID 3223, SEQ ID 3224, SEQ ID 3225, SEQ ID 3226, SEQ ID 3227, SEQ ID 3228, SEQ ID 3229, SEQ ID 3230, SEQ ID 3231, SEQ ID 3232, SEQ ID 3233, SEQ ID 3234, SEQ ID 3235, SEQ ID 3236, SEQ ID 3237, SEQ ID 3238, SEQ ID 3239, SEQ ID 3240, SEQ ID 3241, SEQ ID 3242, SEQ ID 3243, SEQ ID 3244, SEQ ID 3245, SEQ ID 3246, SEQ ID 3248, SEQ ID 3249, SEQ ID 3250, SEQ ID 3251, SEQ ID 3252, SEQ ID 3253, SEQ ID 3254, SEQ ID 3255, SEQ ID 3256, SEQ ID 3257, SEQ ID 3258, SEQ ID 3259, SEQ ID 3260, SEQ ID 3261, SEQ ID 3262, SEQ ID 3263, SEQ ID 3264, SEQ ID 3265, SEQ ID 3266, SEQ ID 3267, SEQ ID 3268, SEQ ID 3269, SEQ ID 3270, SEQ ID 3271, SEQ ID 3272, SEQ ID 3273, SEQ ID 3275, SEQ ID 3276, SEQ ID 3277, SEQ ID 3278, SEQ ID 3279, SEQ ID 3280, SEQ ID 3282, SEQ ID 3284, SEQ ID 3285, SEQ ID 3286, SEQ ID 3287, SEQ ID 3288, SEQ ID 3289, SEQ ID 3291, SEQ ID 3292, SEQ ID 3293, SEQ ID 3294, SEQ ID 3295, SEQ ID 3296, SEQ ID 3297, SEQ ID 3298, SEQ ID 3299, SEQ ID 3300, SEQ ID 3301, SEQ ID 3302, SEQ ID 3303, SEQ ID 3304, SEQ ID 3305, SEQ ID 3306, SEQ ID 3307, SEQ ID 3308, SEQ ID 3309, SEQ ID 3310, SEQ ID 3311, SEQ ID 3312, SEQ ID 3313, SEQ ID 3314, SEQ ID 3315, SEQ ID 3316, SEQ ID 3317, SEQ ID 3318, SEQ ID 3320, SEQ ID 3321, SEQ ID 3322, SEQ ID 3323, SEQ ID 3324, SEQ ID 3325, SEQ ID 3326, SEQ ID 3327, SEQ ID 3329, SEQ ID 3331, SEQ ID 3332, SEQ ID 3333, SEQ ID 3334, SEQ ID 3335, SEQ ID 3336, SEQ ID 3337, SEQ ID 3338, SEQ ID 3339, SEQ ID 3340, SEQ ID 3342, SEQ ID 3343, SEQ ID 3344, SEQ ID 3345, SEQ ID 3346, SEQ ID 3347, SEQ ID 3348, SEQ ID 3349, SEQ ID 3350, SEQ ID 3351, SEQ ID 3352, SEQ ID 3353, SEQ ID 3354, SEQ ID 3355, SEQ ID 3356, SEQ ID 3357, SEQ ID 3358, SEQ ID 3359, SEQ ID 3360, SEQ ID 3361, SEQ ID 3362, SEQ ID 3363, SEQ ID 3364, SEQ ID 3365, SEQ ID 3366, SEQ ID 3367, SEQ ID 3368, SEQ ID 3369, SEQ ID 3370, SEQ ID 3371, SEQ ID 3390, SEQ ID 3391, SEQ ID 3392, SEQ ID 3393, SEQ ID 3394, SEQ ID 3395, SEQ ID 3396, SEQ ID 3397, SEQ ID 3398, SEQ ID 3399, SEQ ID 3400, SEQ ID 3401, SEQ ID 3402, SEQ ID 3403, SEQ ID 3404, SEQ ID 3405, SEQ ID 3406, SEQ ID 3407, SEQ ID 3408, SEQ ID 3409, SEQ ID 3410, SEQ ID 3411, SEQ ID 3412, SEQ ID 3413, SEQ ID 3414, SEQ ID 3415, SEQ ID 3416, SEQ ID 3417, SEQ ID 3418, SEQ ID 3419, SEQ ID 3420, SEQ ID 3421, SEQ ID 3422, SEQ ID 3423, SEQ ID 3424, SEQ ID 3425, SEQ ID 3426, SEQ ID 3427, SEQ ID 3428, SEQ ID 3429, SEQ ID 3430, SEQ ID 3431, SEQ ID 3432, SEQ ID 3433, SEQ ID 3434, SEQ ID 3435, SEQ ID 3436, SEQ ID 3437, SEQ ID 3438, SEQ ID 3439, SEQ ID 3440, SEQ ID 3441, SEQ ID 3442, SEQ ID 3443, SEQ ID 3444, SEQ ID 3445, SEQ ID 3446, SEQ ID 3447, SEQ ID 3448, SEQ ID 3449, SEQ ID 3450, SEQ ID 3451, SEQ ID 3452, SEQ ID 3453, SEQ ID 3454, SEQ ID 3460, SEQ ID 3461, SEQ ID 3464, SEQ ID 3465, SEQ ID 3466, SEQ ID 3467, SEQ ID 3468, SEQ ID 3486, SEQ ID 3487, SEQ ID 3488, SEQ ID 3489, SEQ ID 3490, SEQ ID 3491, SEQ ID 3493, SEQ ID 3494, SEQ ID 3496, SEQ ID 3497, SEQ ID 3501, SEQ ID 3505, SEQ ID 3508, SEQ ID 3511, SEQ ID 3512, SEQ ID 3516, SEQ ID 3517, SEQ ID 3518, SEQ ID 3521, SEQ ID 3522, SEQ ID 3523, SEQ ID 3524, SEQ ID 3525, SEQ ID 3526, SEQ ID 3527, SEQ ID 3528, SEQ ID 3530, SEQ ID 3531, SEQ ID 3532, SEQ ID 3534, SEQ ID 3535, SEQ ID 3536, SEQ ID 3538, SEQ ID 3539, SEQ ID 3541, SEQ ID 3542, SEQ ID 3543, SEQ ID 3544, SEQ ID 3546, SEQ ID 3548, SEQ ID 3549, SEQ ID 3550, SEQ ID 3552, SEQ ID 3556, SEQ ID 3557, SEQ ID 3558, SEQ ID 3560, SEQ ID 3561, SEQ ID 3566, SEQ ID 3567, SEQ ID 3568, SEQ ID 3569, SEQ ID 3571, SEQ ID 3572, SEQ ID 3573, SEQ ID 3574, SEQ ID 3576, SEQ ID 3577, SEQ ID 3578, SEQ ID 3580, SEQ ID 3581, SEQ ID 3584, SEQ ID 3585, SEQ ID 3586, SEQ ID 3588, SEQ ID 3590, SEQ ID 3592, SEQ ID 3594, SEQ ID 3595, SEQ ID 3598, SEQ ID 3599, SEQ ID 3600, SEQ ID 3601, SEQ ID 3602, SEQ ID 3603, SEQ ID 3605, SEQ ID 3607, SEQ ID 3609, SEQ ID 3610, SEQ ID 3613, SEQ ID 3614, SEQ ID 3615, SEQ ID 3616, SEQ ID 3617, SEQ ID 3621, SEQ ID 3623, SEQ ID 3624, SEQ ID 3625, SEQ ID 3626, SEQ ID 3627, SEQ ID 3628, SEQ ID 3629, SEQ ID 3630, SEQ ID 3631, SEQ ID 3632, SEQ ID 3633, SEQ ID 3636, SEQ ID 3637, SEQ ID 3638, SEQ ID 3639, SEQ ID 3641, SEQ ID 3642, SEQ ID 3643, SEQ ID 3645, SEQ ID 3647, SEQ ID 3648, SEQ ID 3649, SEQ ID 3651, SEQ ID 3654, SEQ ID 3656, SEQ ID 3659, SEQ ID 3660, SEQ ID 3661, SEQ ID 3663, SEQ ID 3664, SEQ ID 3665, SEQ ID 3666, SEQ ID 3670, SEQ ID 3672, SEQ ID 3676, SEQ ID 3678, SEQ ID 3679, SEQ ID 3680, SEQ ID 3681, SEQ ID 3682, SEQ ID 3683, SEQ ID 3684, SEQ ID 3685, SEQ ID 3686, SEQ ID 3687, SEQ ID 3688, SEQ ID 3689, SEQ ID 3690, SEQ ID 3691, SEQ ID 3692, SEQ ID 3693, SEQ ID 3694, SEQ ID 3695, SEQ ID 3696, SEQ ID 3697, SEQ ID 3698, SEQ ID 3699, SEQ ID 3700, SEQ ID 3701, SEQ ID 3702, SEQ ID 3703, SEQ ID 3704, SEQ ID 3705, SEQ ID 3706, SEQ ID 3707, SEQ ID 3708, SEQ ID 3709, SEQ ID 3710, SEQ ID 3711, SEQ ID 3712, SEQ ID 3713, SEQ ID 3714, SEQ ID 3715, SEQ ID 3716, SEQ ID 3717, SEQ ID 3718, SEQ ID 3719, SEQ ID 3720, SEQ ID 3721, SEQ ID 3722, SEQ ID 3723, SEQ ID 3724, SEQ ID 3725, SEQ ID 3726, SEQ ID 3727, SEQ ID 3729, SEQ ID 3730, SEQ ID 3731, SEQ ID 3732, SEQ ID 3733, SEQ ID 3734, SEQ ID 3735, SEQ ID 3736, SEQ ID 3737, SEQ ID 3738, SEQ ID 3739, SEQ ID 3740, SEQ ID 3741, SEQ ID 3742, SEQ ID 3743, SEQ ID 3744, SEQ ID 3745, SEQ ID 3746, SEQ ID 3747, SEQ ID 3748, SEQ ID 3749, SEQ ID 3750, SEQ ID 3751, SEQ ID 3752, SEQ ID 3753, SEQ ID 3754, SEQ ID 3755, SEQ ID 3774, SEQ ID 3775, SEQ ID 3776, SEQ ID 3777, SEQ ID 3778, SEQ ID 3779, SEQ ID 3780, SEQ ID 3781, SEQ ID 3782, SEQ ID 3783, SEQ ID 3784, SEQ ID 3785, SEQ ID 3786, SEQ ID 3787, SEQ ID 3788, SEQ ID 3789, SEQ ID 3790, SEQ ID 3791, SEQ ID 3792, SEQ ID 3793, SEQ ID 3794, SEQ ID 3795, SEQ ID 3796, SEQ ID 3797, SEQ ID 3798, SEQ ID 3799, SEQ ID 3800, SEQ ID 3801, SEQ ID 3802, SEQ ID 3803, SEQ ID 3804, SEQ ID 3805, SEQ ID 3806, SEQ ID 3807, SEQ ID 3808, SEQ ID 3809, SEQ ID 3810, SEQ ID 3811, SEQ ID 3812, SEQ ID 3813, SEQ ID 3814, SEQ ID 3815, SEQ ID 3816, SEQ ID 3817, SEQ ID 3818, SEQ ID 3819, SEQ ID 3820, SEQ ID 3821, SEQ ID 3822, SEQ ID 3823, SEQ ID 3824, SEQ ID 3825, SEQ ID 3826, SEQ ID 3827, SEQ ID 3828, SEQ ID 3829, SEQ ID 3830, SEQ ID 3831, SEQ ID 3832, SEQ ID 3833, SEQ ID 3834, SEQ ID 3835, SEQ ID 3836, SEQ ID 3837, SEQ ID 3838, SEQ ID 3839, SEQ ID 3840, SEQ ID 3841, SEQ ID 3842, SEQ ID 3844, SEQ ID 3848, SEQ ID 3850, SEQ ID 3851, SEQ ID 3852, SEQ ID 3853, SEQ ID 3867, SEQ ID 3868, SEQ ID 3869, SEQ ID 3870, SEQ ID 3871, SEQ ID 3872, SEQ ID 3873, SEQ ID 3874, SEQ ID 3875, SEQ ID 3876, SEQ ID 3877, SEQ ID 3878, SEQ ID 3879, SEQ ID 3880, SEQ ID 3881, SEQ ID 3882, SEQ ID 3883, SEQ ID 3884, SEQ ID 3885, SEQ ID 3886, SEQ ID 3887, SEQ ID 3888, SEQ ID 3889, SEQ ID 3890, SEQ ID 3891, SEQ ID 3892, SEQ ID 3893, SEQ ID 3894, SEQ ID 3895, SEQ ID 3896, SEQ ID 3897, SEQ ID 3898, SEQ ID 3899, SEQ ID 3900, SEQ ID 3901, SEQ ID 3902, SEQ ID 3903, SEQ ID 3904, SEQ ID 3905, SEQ ID 3906, SEQ ID 3907, SEQ ID 3908, SEQ ID 3909, SEQ ID 3910, SEQ ID 3911, SEQ ID 3912, SEQ ID 3913, SEQ ID 3914, SEQ ID 3915, SEQ ID 3916, SEQ ID 3917, SEQ ID 3918, SEQ ID 3919, SEQ ID 3920, SEQ ID 3921, SEQ ID 3922, SEQ ID 3923, SEQ ID 3924, SEQ ID 3925, SEQ ID 3926, SEQ ID 3927, SEQ ID 3928, SEQ ID 3929, SEQ ID 3930, SEQ ID 3931, SEQ ID 3932, SEQ ID 3933, SEQ ID 3934, SEQ ID 3935, SEQ ID 3936, SEQ ID 3937, SEQ ID 3938, SEQ ID 3939, SEQ ID 3940, SEQ ID 3941, SEQ ID 3942, SEQ ID 3943, SEQ ID 3944, SEQ ID 3945, SEQ ID 3946, SEQ ID 3947, and SEQ ID 3948, or at least 8, 9, 10, 11, 12, 13, 14, 15 or 16 contiguous nucleotides thereof.

In some embodiments, the contiguous nucleotide sequence is complementary, such as fully complementary, to a sequence selected from the group consisting of SEQ ID 2321, SEQ ID 2335, SEQ ID 2336, SEQ ID 2337, SEQ ID 2338, SEQ ID 2339, SEQ ID 2348, SEQ ID 2349, SEQ ID 2351, SEQ ID 2352, SEQ ID 2353, SEQ ID 2354, SEQ ID 2355, SEQ ID 2358, SEQ ID 2360, SEQ ID 2364, SEQ ID 2365, SEQ ID 2366, SEQ ID 2367, SEQ ID 2369, SEQ ID 2371, SEQ ID 2373, SEQ ID 2375, SEQ ID 2386, SEQ ID 2387, SEQ ID 2388, SEQ ID 2389, SEQ ID 2394, SEQ ID 2403, SEQ ID 2426, SEQ ID 2428, SEQ ID 2429, SEQ ID 2430, SEQ ID 2431, SEQ ID 2432, SEQ ID 2435, SEQ ID 2440, SEQ ID 2441, SEQ ID 2442, SEQ ID 2444, SEQ ID 2446, SEQ ID 2447, SEQ ID 2450, SEQ ID 2451, SEQ ID 2452, SEQ ID 2453, SEQ ID 2454, SEQ ID 2455, SEQ ID 2456, SEQ ID 2458, SEQ ID 2459, SEQ ID 2461, SEQ ID 2463, SEQ ID 2464, SEQ ID 2465, SEQ ID 2466, SEQ ID 2467, SEQ ID 2468, SEQ ID 2469, SEQ ID 2470, SEQ ID 2471, SEQ ID 2472, SEQ ID 2473, SEQ ID 2474, SEQ ID 2475, SEQ ID 2476, SEQ ID 2477, SEQ ID 2478, SEQ ID 2482, SEQ ID 2483, SEQ ID 2484, SEQ ID 2485, SEQ ID 2487, SEQ ID 2489, SEQ ID 2494, SEQ ID 2495, SEQ ID 2496, SEQ ID 2497, SEQ ID 2499, SEQ ID 2501, SEQ ID 2502, SEQ ID 2504, SEQ ID 2506, SEQ ID 2507, SEQ ID 2508, SEQ ID 2509, SEQ ID 2511, SEQ ID 2513, SEQ ID 2515, SEQ ID 2516, SEQ ID 2518, SEQ ID 2519, SEQ ID 2520, SEQ ID 2521, SEQ ID 2523, SEQ ID 2525, SEQ ID 2534, SEQ ID 2537, SEQ ID 2544, SEQ ID 2546, SEQ ID 2554, SEQ ID 2555, SEQ ID 2556, SEQ ID 2560, SEQ ID 2561, SEQ ID 2562, SEQ ID 2595, SEQ ID 2626, SEQ ID 2628, SEQ ID 2629, SEQ ID 2630, SEQ ID 2631, SEQ ID 2633, SEQ ID 2638, SEQ ID 2639, SEQ ID 2640, SEQ ID 2649, SEQ ID 2651, SEQ ID 2652, SEQ ID 2655, SEQ ID 2658, SEQ ID 2665, SEQ ID 2666, SEQ ID 2667, SEQ ID 2669, SEQ ID 2670, SEQ ID 2676, SEQ ID 2677, SEQ ID 2678, SEQ ID 2679, SEQ ID 2682, SEQ ID 2686, SEQ ID 2688, SEQ ID 2689, SEQ ID 2691, SEQ ID 2694, SEQ ID 2698, SEQ ID 2699, SEQ ID 2700, SEQ ID 2701, SEQ ID 2703, SEQ ID 2706, SEQ ID 2709, SEQ ID 2711, SEQ ID 2712, SEQ ID 2713, SEQ ID 2714, SEQ ID 2719, SEQ ID 2720, SEQ ID 2721, SEQ ID 2737, SEQ ID 2739, SEQ ID 2740, SEQ ID 2741, SEQ ID 2742, SEQ ID 2743, SEQ ID 2744, SEQ ID 2745, SEQ ID 2746, SEQ ID 2747, SEQ ID 2748, SEQ ID 2749, SEQ ID 2750, SEQ ID 2751, SEQ ID 2752, SEQ ID 2753, SEQ ID 2754, SEQ ID 2755, SEQ ID 2756, SEQ ID 2757, SEQ ID 2758, SEQ ID 2760, SEQ ID 2763, SEQ ID 2764, SEQ ID 2765, SEQ ID 2766, SEQ ID 2767, SEQ ID 2768, SEQ ID 2769, SEQ ID 2770, SEQ ID 2771, SEQ ID 2772, SEQ ID 2774, SEQ ID 2816, SEQ ID 2817, SEQ ID 2818, SEQ ID 2819, SEQ ID 2820, SEQ ID 2824, SEQ ID 2828, SEQ ID 2829, SEQ ID 2830, SEQ ID 2831, SEQ ID 2832, SEQ ID 2833, SEQ ID 2834, SEQ ID 2835, SEQ ID 2836, SEQ ID 2837, SEQ ID 2851, SEQ ID 2852, SEQ ID 2866, SEQ ID 2871, SEQ ID 2872, SEQ ID 2886, SEQ ID 2887, SEQ ID 2890, SEQ ID 2891, SEQ ID 2892, SEQ ID 2895, SEQ ID 2896, SEQ ID 2899, SEQ ID 2904, SEQ ID 2910, SEQ ID 2911, SEQ ID 2912, SEQ ID 2913, SEQ ID 2914, SEQ ID 2916, SEQ ID 2918, SEQ ID 2919, SEQ ID 2920, SEQ ID 2922, SEQ ID 2925, SEQ ID 2926, SEQ ID 2932, SEQ ID 2939, SEQ ID 2941, SEQ ID 2942, SEQ ID 2943, SEQ ID 2972, SEQ ID 2973, SEQ ID 2974, SEQ ID 2975, SEQ ID 2976, SEQ ID 2977, SEQ ID 2980, SEQ ID 2983, SEQ ID 2985, SEQ ID 3053, SEQ ID 3054, SEQ ID 3055, SEQ ID 3056, SEQ ID 3058, SEQ ID 3059, SEQ ID 3060, SEQ ID 3061, SEQ ID 3062, SEQ ID 3063, SEQ ID 3064, SEQ ID 3065, SEQ ID 3066, SEQ ID 3068, SEQ ID 3069, SEQ ID 3070, SEQ ID 3071, SEQ ID 3072, SEQ ID 3073, SEQ ID 3074, SEQ ID 3075, SEQ ID 3076, SEQ ID 3077, SEQ ID 3078, SEQ ID 3079, SEQ ID 3082, SEQ ID 3083, SEQ ID 3084, SEQ ID 3085, SEQ ID 3088, SEQ ID 3089, SEQ ID 3090, SEQ ID 3091, SEQ ID 3092, SEQ ID 3095, SEQ ID 3097, SEQ ID 3102, SEQ ID 3106, SEQ ID 3108, SEQ ID 3110, SEQ ID 3116, SEQ ID 3120, SEQ ID 3121, SEQ ID 3125, SEQ ID 3126, SEQ ID 3133, SEQ ID 3134, SEQ ID 3135, SEQ ID 3137, SEQ ID 3138, SEQ ID 3140, SEQ ID 3141, SEQ ID 3142, SEQ ID 3143, SEQ ID 3145, SEQ ID 3148, SEQ ID 3152, SEQ ID 3153, SEQ ID 3156, SEQ ID 3157, SEQ ID 3158, SEQ ID 3159, SEQ ID 3160, SEQ ID 3161, SEQ ID 3162, SEQ ID 3163, SEQ ID 3164, SEQ ID 3165, SEQ ID 3166, SEQ ID 3167, SEQ ID 3168, SEQ ID 3169, SEQ ID 3170, SEQ ID 3172, SEQ ID 3173, SEQ ID 3174, SEQ ID 3175, SEQ ID 3176, SEQ ID 3177, SEQ ID 3178, SEQ ID 3179, SEQ ID 3180, SEQ ID 3181, SEQ ID 3182, SEQ ID 3183, SEQ ID 3184, SEQ ID 3186, SEQ ID 3188, SEQ ID 3191, SEQ ID 3193, SEQ ID 3196, SEQ ID 3197, SEQ ID 3203, SEQ ID 3205, SEQ ID 3206, SEQ ID 3207, SEQ ID 3210, SEQ ID 3211, SEQ ID 3212, SEQ ID 3213, SEQ ID 3214, SEQ ID 3215, SEQ ID 3216, SEQ ID 3217, SEQ ID 3218, SEQ ID 3219, SEQ ID 3221, SEQ ID 3222, SEQ ID 3223, SEQ ID 3224, SEQ ID 3227, SEQ ID 3236, SEQ ID 3237, SEQ ID 3238, SEQ ID 3239, SEQ ID 3240, SEQ ID 3241, SEQ ID 3242, SEQ ID 3243, SEQ ID 3244, SEQ ID 3245, SEQ ID 3246, SEQ ID 3248, SEQ ID 3249, SEQ ID 3250, SEQ ID 3251, SEQ ID 3252, SEQ ID 3254, SEQ ID 3258, SEQ ID 3259, SEQ ID 3261, SEQ ID 3263, SEQ ID 3265, SEQ ID 3266, SEQ ID 3267, SEQ ID 3271, SEQ ID 3272, SEQ ID 3273, SEQ ID 3276, SEQ ID 3277, SEQ ID 3279, SEQ ID 3286, SEQ ID 3295, SEQ ID 3297, SEQ ID 3305, SEQ ID 3307, SEQ ID 3309, SEQ ID 3312, SEQ ID 3313, SEQ ID 3314, SEQ ID 3316, SEQ ID 3317, SEQ ID 3318, SEQ ID 3320, SEQ ID 3332, SEQ ID 3335, SEQ ID 3336, SEQ ID 3337, SEQ ID 3338, SEQ ID 3339, SEQ ID 3340, SEQ ID 3342, SEQ ID 3343, SEQ ID 3345, SEQ ID 3346, SEQ ID 3347, SEQ ID 3348, SEQ ID 3349, SEQ ID 3350, SEQ ID 3351, SEQ ID 3352, SEQ ID 3353, SEQ ID 3354, SEQ ID 3355, SEQ ID 3356, SEQ ID 3359, SEQ ID 3360, SEQ ID 3361, SEQ ID 3362, SEQ ID 3363, SEQ ID 3364, SEQ ID 3365, SEQ ID 3366, SEQ ID 3369, SEQ ID 3370, SEQ ID 3390, SEQ ID 3392, SEQ ID 3393, SEQ ID 3394, SEQ ID 3395, SEQ ID 3396, SEQ ID 3397, SEQ ID 3398, SEQ ID 3399, SEQ ID 3401, SEQ ID 3403, SEQ ID 3404, SEQ ID 3407, SEQ ID 3408, SEQ ID 3409, SEQ ID 3410, SEQ ID 3411, SEQ ID 3412, SEQ ID 3413, SEQ ID 3414, SEQ ID 3415, SEQ ID 3417, SEQ ID 3419, SEQ ID 3420, SEQ ID 3422, SEQ ID 3423, SEQ ID 3424, SEQ ID 3428, SEQ ID 3429, SEQ ID 3430, SEQ ID 3432, SEQ ID 3433, SEQ ID 3434, SEQ ID 3435, SEQ ID 3436, SEQ ID 3437, SEQ ID 3439, SEQ ID 3440, SEQ ID 3441, SEQ ID 3442, SEQ ID 3443, SEQ ID 3444, SEQ ID 3445, SEQ ID 3446, SEQ ID 3447, SEQ ID 3448, SEQ ID 3449, SEQ ID 3450, SEQ ID 3451, SEQ ID 3452, SEQ ID 3460, SEQ ID 3461, SEQ ID 3466, SEQ ID 3467, SEQ ID 3468, SEQ ID 3490, SEQ ID 3494, SEQ ID 3496, SEQ ID 3501, SEQ ID 3505, SEQ ID 3511, SEQ ID 3512, SEQ ID 3516, SEQ ID 3517, SEQ ID 3521, SEQ ID 3522, SEQ ID 3556, SEQ ID 3557, SEQ ID 3561, SEQ ID 3566, SEQ ID 3567, SEQ ID 3568, SEQ ID 3569, SEQ ID 3571, SEQ ID 3572, SEQ ID 3576, SEQ ID 3578, SEQ ID 3580, SEQ ID 3584, SEQ ID 3594, SEQ ID 3613, SEQ ID 3614, SEQ ID 3624, SEQ ID 3625, SEQ ID 3626, SEQ ID 3627, SEQ ID 3628, SEQ ID 3633, SEQ ID 3641, SEQ ID 3643, SEQ ID 3648, SEQ ID 3651, SEQ ID 3654, SEQ ID 3656, SEQ ID 3659, SEQ ID 3660, SEQ ID 3661, SEQ ID 3670, SEQ ID 3676, SEQ ID 3680, SEQ ID 3681, SEQ ID 3683, SEQ ID 3684, SEQ ID 3685, SEQ ID 3686, SEQ ID 3687, SEQ ID 3688, SEQ ID 3689, SEQ ID 3691, SEQ ID 3693, SEQ ID 3694, SEQ ID 3695, SEQ ID 3696, SEQ ID 3698, SEQ ID 3700, SEQ ID 3701, SEQ ID 3703, SEQ ID 3704, SEQ ID 3707, SEQ ID 3708, SEQ ID 3709, SEQ ID 3710, SEQ ID 3711, SEQ ID 3712, SEQ ID 3713, SEQ ID 3714, SEQ ID 3715, SEQ ID 3716, SEQ ID 3717, SEQ ID 3718, SEQ ID 3719, SEQ ID 3720, SEQ ID 3721, SEQ ID 3722, SEQ ID 3723, SEQ ID 3725, SEQ ID 3744, SEQ ID 3747, SEQ ID 3748, SEQ ID 3749, SEQ ID 3750, SEQ ID 3751, SEQ ID 3752, SEQ ID 3753, SEQ ID 3754, SEQ ID 3755, SEQ ID 3774, SEQ ID 3775, SEQ ID 3776, SEQ ID 3786, SEQ ID 3788, SEQ ID 3790, SEQ ID 3791, SEQ ID 3793, SEQ ID 3794, SEQ ID 3795, SEQ ID 3796, SEQ ID 3797, SEQ ID 3798, SEQ ID 3799, SEQ ID 3800, SEQ ID 3801, SEQ ID 3802, SEQ ID 3803, SEQ ID 3804, SEQ ID 3805, SEQ ID 3809, SEQ ID 3810, SEQ ID 3811, SEQ ID 3812, SEQ ID 3813, SEQ ID 3814, SEQ ID 3815, SEQ ID 3821, SEQ ID 3822, SEQ ID 3823, SEQ ID 3824, SEQ ID 3825, SEQ ID 3826, SEQ ID 3827, SEQ ID 3828, SEQ ID 3830, SEQ ID 3831, SEQ ID 3832, SEQ ID 3834, SEQ ID 3836, SEQ ID 3837, SEQ ID 3838, SEQ ID 3839, SEQ ID 3840, SEQ ID 3841, SEQ ID 3842, SEQ ID 3844, SEQ ID 3850, SEQ ID 3852, SEQ ID 3867, SEQ ID 3868, SEQ ID 3870, SEQ ID 3871, SEQ ID 3872, SEQ ID 3873, SEQ ID 3874, SEQ ID 3875, SEQ ID 3876, SEQ ID 3879, SEQ ID 3880, SEQ ID 3881, SEQ ID 3882, SEQ ID 3883, SEQ ID 3884, SEQ ID 3885, SEQ ID 3886, SEQ ID 3887, SEQ ID 3888, SEQ ID 3889, SEQ ID 3890, SEQ ID 3891, SEQ ID 3892, SEQ ID 3893, SEQ ID 3894, SEQ ID 3895, SEQ ID 3896, SEQ ID 3897, SEQ ID 3908, SEQ ID 3909, SEQ ID 3910, SEQ ID 3911, SEQ ID 3912, SEQ ID 3913, SEQ ID 3922, SEQ ID 3923, SEQ ID 3930, SEQ ID 3935, SEQ ID 3936, SEQ ID 3937, SEQ ID 3938, SEQ ID 3939, SEQ ID 3940, SEQ ID 3944, SEQ ID 3945, SEQ ID 3946, SEQ ID 3947, and SEQ ID 3948, or at least 8, 9, 10, 11, 12, 13, 14, 15 or 16 contiguous nucleotides thereof.

In some embodiments the contiguous nucleotide sequence is complementary, such as fully complementary, to at least 8 contiguous nucleotides of any of the target sequences recited herein.

In some embodiments the contiguous nucleotide sequence is complementary, such as fully complementary, to at least 9 contiguous nucleotides of any of the target sequences recited herein.

In some embodiments the contiguous nucleotide sequence is complementary, such as fully complementary, to at least 10 contiguous nucleotides contiguous nucleotides of any of the target sequences recited herein.

In some embodiments the contiguous nucleotide sequence is complementary, such as fully complementary, to at least 11 contiguous nucleotides contiguous nucleotides of any of the target sequences recited herein.

In some embodiments the contiguous nucleotide sequence is complementary, such as fully complementary, to at least 12 contiguous nucleotides contiguous nucleotides of any of the target sequences recited herein.

In some embodiments the contiguous nucleotide sequence is complementary, such as fully complementary, to at least 13 contiguous nucleotides contiguous nucleotides of any of the target sequences recited herein.

In some embodiments the contiguous nucleotide sequence is complementary, such as fully complementary, to at least 14 contiguous nucleotides contiguous nucleotides of any of the target sequences recited herein.

In some embodiments the contiguous nucleotide sequence is complementary, such as fully complementary, to at least 15 contiguous nucleotides contiguous nucleotides of any of the target sequences recited herein.

In some embodiments the contiguous nucleotide sequence is complementary, such as fully complementary, to at least 16 contiguous nucleotides contiguous nucleotides of any of the target sequences recited herein.

In some embodiments, the antisense oligonucleotide progranulin agonist is or comprises an antisense oligonucleotide mixmer or totalmer. In some embodiments, the contiguous nucleotide sequence is a mixmer or a totalmer.

In some embodiments, the antisense oligonucleotide progranulin agonist or contiguous nucleotide sequence thereof is 10-20 nucleotides in length.

In some embodiments, the antisense oligonucleotide progranulin agonist is selected from the group consisting of SEQ ID NOs 3-342.

In some embodiments, the antisense oligonucleotide progranulin agonist is selected from the group consisting of SEQ ID NOs 693-2039.

In some embodiments, the antisense oligonucleotide progranulin agonist is selected from the group consisting of SEQ ID 693, SEQ ID 694, SEQ ID 696, SEQ ID 700, SEQ ID 701, SEQ ID 703, SEQ ID 706, SEQ ID 707, SEQ ID 708, SEQ ID 709, SEQ ID 710, SEQ ID 711, SEQ ID 712, SEQ ID 713, SEQ ID 714, SEQ ID 717, SEQ ID 718, SEQ ID 719, SEQ ID 720, SEQ ID 721, SEQ ID 722, SEQ ID 723, SEQ ID 724, SEQ ID 725, SEQ ID 726, SEQ ID 727, SEQ ID 728, SEQ ID 729, SEQ ID 730, SEQ ID 731, SEQ ID 732, SEQ ID 733, SEQ ID 734, SEQ ID 736, SEQ ID 737, SEQ ID 738, SEQ ID 739, SEQ ID 740, SEQ ID 741, SEQ ID 742, SEQ ID 743, SEQ ID 744, SEQ ID 745, SEQ ID 746, SEQ ID 747, SEQ ID 748, SEQ ID 749, SEQ ID 750, SEQ ID 751, SEQ ID 752, SEQ ID 753, SEQ ID 756, SEQ ID 758, SEQ ID 759, SEQ ID 760, SEQ ID 761, SEQ ID 762, SEQ ID 764, SEQ ID 765, SEQ ID 766, SEQ ID 767, SEQ ID 768, SEQ ID 769, SEQ ID 770, SEQ ID 771, SEQ ID 772, SEQ ID 773, SEQ ID 775, SEQ ID 776, SEQ ID 777, SEQ ID 778, SEQ ID 779, SEQ ID 780, SEQ ID 782, SEQ ID 783, SEQ ID 785, SEQ ID 786, SEQ ID 787, SEQ ID 788, SEQ ID 790, SEQ ID 791, SEQ ID 793, SEQ ID 796, SEQ ID 797, SEQ ID 798, SEQ ID 799, SEQ ID 800, SEQ ID 801, SEQ ID 802, SEQ ID 803, SEQ ID 804, SEQ ID 805, SEQ ID 806, SEQ ID 807, SEQ ID 808, SEQ ID 809, SEQ ID 810, SEQ ID 811, SEQ ID 812, SEQ ID 813, SEQ ID 814, SEQ ID 815, SEQ ID 816, SEQ ID 817, SEQ ID 818, SEQ ID 819, SEQ ID 820, SEQ ID 821, SEQ ID 822, SEQ ID 823, SEQ ID 824, SEQ ID 825, SEQ ID 826, SEQ ID 827, SEQ ID 828, SEQ ID 829, SEQ ID 830, SEQ ID 831, SEQ ID 832, SEQ ID 833, SEQ ID 834, SEQ ID 835, SEQ ID 836, SEQ ID 837, SEQ ID 838, SEQ ID 839, SEQ ID 840, SEQ ID 841, SEQ ID 842, SEQ ID 843, SEQ ID 844, SEQ ID 845, SEQ ID 846, SEQ ID 847, SEQ ID 848, SEQ ID 849, SEQ ID 850, SEQ ID 851, SEQ ID 853, SEQ ID 854, SEQ ID 855, SEQ ID 856, SEQ ID 857, SEQ ID 859, SEQ ID 861, SEQ ID 862, SEQ ID 863, SEQ ID 864, SEQ ID 865, SEQ ID 866, SEQ ID 867, SEQ ID 868, SEQ ID 869, SEQ ID 870, SEQ ID 871, SEQ ID 873, SEQ ID 874, SEQ ID 875, SEQ ID 876, SEQ ID 877, SEQ ID 878, SEQ ID 879, SEQ ID 880, SEQ ID 881, SEQ ID 882, SEQ ID 883, SEQ ID 884, SEQ ID 885, SEQ ID 886, SEQ ID 887, SEQ ID 888, SEQ ID 890, SEQ ID 891, SEQ ID 892, SEQ ID 893, SEQ ID 894, SEQ ID 895, SEQ ID 896, SEQ ID 897, SEQ ID 898, SEQ ID 899, SEQ ID 900, SEQ ID 903, SEQ ID 905, SEQ ID 906, SEQ ID 907, SEQ ID 908, SEQ ID 909, SEQ ID 910, SEQ ID 912, SEQ ID 913, SEQ ID 914, SEQ ID 916, SEQ ID 918, SEQ ID 919, SEQ ID 921, SEQ ID 922, SEQ ID 923, SEQ ID 925, SEQ ID 926, SEQ ID 927, SEQ ID 928, SEQ ID 929, SEQ ID 932, SEQ ID 933, SEQ ID 934, SEQ ID 935, SEQ ID 937, SEQ ID 938, SEQ ID 939, SEQ ID 944, SEQ ID 945, SEQ ID 946, SEQ ID 947, SEQ ID 948, SEQ ID 949, SEQ ID 950, SEQ ID 951, SEQ ID 952, SEQ ID 953, SEQ ID 954, SEQ ID 955, SEQ ID 956, SEQ ID 957, SEQ ID 958, SEQ ID 960, SEQ ID 961, SEQ ID 962, SEQ ID 963, SEQ ID 964, SEQ ID 965, SEQ ID 966, SEQ ID 967, SEQ ID 968, SEQ ID 969, SEQ ID 970, SEQ ID 971, SEQ ID 973, SEQ ID 974, SEQ ID 975, SEQ ID 976, SEQ ID 978, SEQ ID 982, SEQ ID 985, SEQ ID 986, SEQ ID 987, SEQ ID 991, SEQ ID 994, SEQ ID 995, SEQ ID 996, SEQ ID 997, SEQ ID 998, SEQ ID 999, SEQ ID 1000, SEQ ID 1001, SEQ ID 1002, SEQ ID 1003, SEQ ID 1004, SEQ ID 1005, SEQ ID 1006, SEQ ID 1007, SEQ ID 1008, SEQ ID 1009, SEQ ID 1010, SEQ ID 1011, SEQ ID 1012, SEQ ID 1013, SEQ ID 1014, SEQ ID 1015, SEQ ID 1016, SEQ ID 1017, SEQ ID 1018, SEQ ID 1019, SEQ ID 1020, SEQ ID 1021, SEQ ID 1022, SEQ ID 1023, SEQ ID 1024, SEQ ID 1025, SEQ ID 1026, SEQ ID 1027, SEQ ID 1028, SEQ ID 1030, SEQ ID 1031, SEQ ID 1032, SEQ ID 1033, SEQ ID 1034, SEQ ID 1035, SEQ ID 1036, SEQ ID 1037, SEQ ID 1038, SEQ ID 1039, SEQ ID 1040, SEQ ID 1041, SEQ ID 1042, SEQ ID 1043, SEQ ID 1044, SEQ ID 1045, SEQ ID 1046, SEQ ID 1047, SEQ ID 1048, SEQ ID 1049, SEQ ID 1050, SEQ ID 1051, SEQ ID 1052, SEQ ID 1053, SEQ ID 1054, SEQ ID 1055, SEQ ID 1056, SEQ ID 1057, SEQ ID 1058, SEQ ID 1059, SEQ ID 1060, SEQ ID 1061, SEQ ID 1062, SEQ ID 1063, SEQ ID 1065, SEQ ID 1066, SEQ ID 1067, SEQ ID 1068, SEQ ID 1069, SEQ ID 1070, SEQ ID 1071, SEQ ID 1072, SEQ ID 1073, SEQ ID 1074, SEQ ID 1075, SEQ ID 1076, SEQ ID 1077, SEQ ID 1078, SEQ ID 1079, SEQ ID 1080, SEQ ID 1081, SEQ ID 1082, SEQ ID 1083, SEQ ID 1084, SEQ ID 1085, SEQ ID 1086, SEQ ID 1087, SEQ ID 1088, SEQ ID 1089, SEQ ID 1090, SEQ ID 1091, SEQ ID 1092, SEQ ID 1093, SEQ ID 1094, SEQ ID 1095, SEQ ID 1098, SEQ ID 1099, SEQ ID 1100, SEQ ID 1101, SEQ ID 1102, SEQ ID 1105, SEQ ID 1106, SEQ ID 1107, SEQ ID 1108, SEQ ID 1109, SEQ ID 1110, SEQ ID 1111, SEQ ID 1112, SEQ ID 1113, SEQ ID 1114, SEQ ID 1115, SEQ ID 1116, SEQ ID 1117, SEQ ID 1118, SEQ ID 1119, SEQ ID 1120, SEQ ID 1121, SEQ ID 1122, SEQ ID 1123, SEQ ID 1124, SEQ ID 1125, SEQ ID 1126, SEQ ID 1127, SEQ ID 1128, SEQ ID 1129, SEQ ID 1130, SEQ ID 1131, SEQ ID 1132, SEQ ID 1133, SEQ ID 1134, SEQ ID 1135, SEQ ID 1136, SEQ ID 1137, SEQ ID 1138, SEQ ID 1139, SEQ ID 1140, SEQ ID 1141, SEQ ID 1142, SEQ ID 1143, SEQ ID 1144, SEQ ID 1145, SEQ ID 1146, SEQ ID 1147, SEQ ID 1187, SEQ ID 1188, SEQ ID 1189, SEQ ID 1190, SEQ ID 1191, SEQ ID 1192, SEQ ID 1193, SEQ ID 1194, SEQ ID 1195, SEQ ID 1196, SEQ ID 1197, SEQ ID 1198, SEQ ID 1199, SEQ ID 1200, SEQ ID 1201, SEQ ID 1202, SEQ ID 1203, SEQ ID 1204, SEQ ID 1205, SEQ ID 1206, SEQ ID 1207, SEQ ID 1208, SEQ ID 1209, SEQ ID 1210, SEQ ID 1211, SEQ ID 1212, SEQ ID 1213, SEQ ID 1214, SEQ ID 1215, SEQ ID 1216, SEQ ID 1217, SEQ ID 1219, SEQ ID 1220, SEQ ID 1221, SEQ ID 1222, SEQ ID 1223, SEQ ID 1224, SEQ ID 1225, SEQ ID 1226, SEQ ID 1227, SEQ ID 1230, SEQ ID 1231, SEQ ID 1232, SEQ ID 1233, SEQ ID 1234, SEQ ID 1235, SEQ ID 1236, SEQ ID 1237, SEQ ID 1238, SEQ ID 1239, SEQ ID 1240, SEQ ID 1241, SEQ ID 1242, SEQ ID 1243, SEQ ID 1244, SEQ ID 1245, SEQ ID 1246, SEQ ID 1247, SEQ ID 1248, SEQ ID 1250, SEQ ID 1251, SEQ ID 1252, SEQ ID 1253, SEQ ID 1254, SEQ ID 1255, SEQ ID 1256, SEQ ID 1257, SEQ ID 1258, SEQ ID 1259, SEQ ID 1260, SEQ ID 1261, SEQ ID 1262, SEQ ID 1263, SEQ ID 1264, SEQ ID 1265, SEQ ID 1266, SEQ ID 1267, SEQ ID 1268, SEQ ID 1269, SEQ ID 1270, SEQ ID 1271, SEQ ID 1272, SEQ ID 1273, SEQ ID 1274, SEQ ID 1275, SEQ ID 1276, SEQ ID 1277, SEQ ID 1278, SEQ ID 1279, SEQ ID 1280, SEQ ID 1281, SEQ ID 1282, SEQ ID 1283, SEQ ID 1284, SEQ ID 1285, SEQ ID 1286, SEQ ID 1287, SEQ ID 1288, SEQ ID 1289, SEQ ID 1290, SEQ ID 1291, SEQ ID 1292, SEQ ID 1293, SEQ ID 1294, SEQ ID 1295, SEQ ID 1296, SEQ ID 1297, SEQ ID 1298, SEQ ID 1299, SEQ ID 1300, SEQ ID 1301, SEQ ID 1302, SEQ ID 1303, SEQ ID 1304, SEQ ID 1306, SEQ ID 1307, SEQ ID 1308, SEQ ID 1309, SEQ ID 1310, SEQ ID 1311, SEQ ID 1312, SEQ ID 1313, SEQ ID 1314, SEQ ID 1315, SEQ ID 1316, SEQ ID 1317, SEQ ID 1318, SEQ ID 1319, SEQ ID 1320, SEQ ID 1321, SEQ ID 1322, SEQ ID 1323, SEQ ID 1325, SEQ ID 1326, SEQ ID 1327, SEQ ID 1328, SEQ ID 1329, SEQ ID 1330, SEQ ID 1332, SEQ ID 1333, SEQ ID 1335, SEQ ID 1336, SEQ ID 1337, SEQ ID 1338, SEQ ID 1339, SEQ ID 1341, SEQ ID 1342, SEQ ID 1343, SEQ ID 1344, SEQ ID 1345, SEQ ID 1346, SEQ ID 1347, SEQ ID 1348, SEQ ID 1349, SEQ ID 1350, SEQ ID 1351, SEQ ID 1352, SEQ ID 1353, SEQ ID 1354, SEQ ID 1355, SEQ ID 1356, SEQ ID 1357, SEQ ID 1425, SEQ ID 1426, SEQ ID 1427, SEQ ID 1428, SEQ ID 1429, SEQ ID 1430, SEQ ID 1431, SEQ ID 1432, SEQ ID 1433, SEQ ID 1434, SEQ ID 1435, SEQ ID 1436, SEQ ID 1437, SEQ ID 1438, SEQ ID 1440, SEQ ID 1441, SEQ ID 1442, SEQ ID 1443, SEQ ID 1444, SEQ ID 1445, SEQ ID 1446, SEQ ID 1447, SEQ ID 1448, SEQ ID 1449, SEQ ID 1450, SEQ ID 1451, SEQ ID 1452, SEQ ID 1453, SEQ ID 1454, SEQ ID 1455, SEQ ID 1456, SEQ ID 1457, SEQ ID 1458, SEQ ID 1459, SEQ ID 1460, SEQ ID 1461, SEQ ID 1462, SEQ ID 1463, SEQ ID 1464, SEQ ID 1465, SEQ ID 1466, SEQ ID 1467, SEQ ID 1469, SEQ ID 1470, SEQ ID 1471, SEQ ID 1472, SEQ ID 1474, SEQ ID 1475, SEQ ID 1476, SEQ ID 1477, SEQ ID 1478, SEQ ID 1479, SEQ ID 1480, SEQ ID 1481, SEQ ID 1482, SEQ ID 1484, SEQ ID 1485, SEQ ID 1487, SEQ ID 1488, SEQ ID 1489, SEQ ID 1491, SEQ ID 1492, SEQ ID SEQ ID 1493, SEQ ID 1494, SEQ ID 1495, SEQ ID 1496, SEQ ID 1497, SEQ ID 1498, SEQ ID 1499, SEQ ID 1500, SEQ ID 1501, SEQ ID 1502, SEQ ID 1503, SEQ ID 1504, SEQ ID 1505, SEQ ID 1506, SEQ ID 1507, SEQ ID 1508, SEQ ID 1509, SEQ ID 1510, SEQ ID 1511, SEQ ID 1512, SEQ ID 1513, SEQ ID 1514, SEQ ID 1515, SEQ ID 1516, SEQ ID 1517, SEQ ID 1518, SEQ ID 1519, SEQ ID 1520, SEQ ID 1521, SEQ ID 1522, SEQ ID 1523, SEQ ID 1524, SEQ ID 1525, SEQ ID 1526, SEQ ID 1527, SEQ ID 1528, SEQ ID 1529, SEQ ID 1530, SEQ ID 1531, SEQ ID 1532, SEQ ID 1533, SEQ ID 1534, SEQ ID 1535, SEQ ID 1536, SEQ ID 1537, SEQ ID 1538, SEQ ID 1539, SEQ ID 1540, SEQ ID 1541, SEQ ID 1542, SEQ ID 1543, SEQ ID 1544, SEQ ID 1545, SEQ ID 1546, SEQ ID 1547, SEQ ID 1548, SEQ ID 1549, SEQ ID 1550, SEQ ID 1551, SEQ ID 1552, SEQ ID 1553, SEQ ID 1554, SEQ ID 1555, SEQ ID 1556, SEQ ID 1557, SEQ ID 1558, SEQ ID 1559, SEQ ID 1560, SEQ ID 1561, SEQ ID 1562, SEQ ID 1563, SEQ ID 1564, SEQ ID 1565, SEQ ID 1566, SEQ ID 1567, SEQ ID 1568, SEQ ID 1569, SEQ ID 1570, SEQ ID 1571, SEQ ID 1572, SEQ ID 1573, SEQ ID 1574, SEQ ID 1575, SEQ ID 1576, SEQ ID 1577, SEQ ID 1578, SEQ ID 1579, SEQ ID 1580, SEQ ID 1581, SEQ ID 1582, SEQ ID 1583, SEQ ID 1584, SEQ ID 1585, SEQ ID 1586, SEQ ID 1587, SEQ ID 1588, SEQ ID 1589, SEQ ID 1590, SEQ ID 1591, SEQ ID 1592, SEQ ID 1593, SEQ ID 1594, SEQ ID 1595, SEQ ID 1596, SEQ ID 1597, SEQ ID 1598, SEQ ID 1599, SEQ ID 1600, SEQ ID 1601, SEQ ID 1602, SEQ ID 1603, SEQ ID 1604, SEQ ID 1605, SEQ ID 1606, SEQ ID 1607, SEQ ID 1608, SEQ ID 1609, SEQ ID 1610, SEQ ID 1611, SEQ ID 1612, SEQ ID 1613, SEQ ID 1614, SEQ ID 1615, SEQ ID 1616, SEQ ID 1617, SEQ ID 1618, SEQ ID 1620, SEQ ID 1621, SEQ ID 1622, SEQ ID 1623, SEQ ID 1624, SEQ ID 1625, SEQ ID 1626, SEQ ID 1627, SEQ ID 1628, SEQ ID 1629, SEQ ID 1630, SEQ ID 1631, SEQ ID 1632, SEQ ID 1633, SEQ ID 1634, SEQ ID 1635, SEQ ID 1636, SEQ ID 1637, SEQ ID 1638, SEQ ID 1639, SEQ ID 1640, SEQ ID 1641, SEQ ID 1642, SEQ ID 1643, SEQ ID 1644, SEQ ID 1645, SEQ ID 1647, SEQ ID 1648, SEQ ID 1649, SEQ ID 1650, SEQ ID 1651, SEQ ID 1652, SEQ ID 1654, SEQ ID 1656, SEQ ID 1657, SEQ ID 1658, SEQ ID 1659, SEQ ID 1660, SEQ ID 1661, SEQ ID 1663, SEQ ID 1664, SEQ ID 1665, SEQ ID 1666, SEQ ID 1667, SEQ ID 1668, SEQ ID 1669, SEQ ID 1670, SEQ ID 1671, SEQ ID 1672, SEQ ID 1673, SEQ ID 1674, SEQ ID 1675, SEQ ID 1676, SEQ ID 1677, SEQ ID 1678, SEQ ID 1679, SEQ ID 1680, SEQ ID 1681, SEQ ID 1682, SEQ ID 1683, SEQ ID 1684, SEQ ID 1685, SEQ ID 1686, SEQ ID 1687, SEQ ID 1688, SEQ ID 1689, SEQ ID 1690, SEQ ID 1692, SEQ ID 1693, SEQ ID 1694, SEQ ID 1695, SEQ ID 1696, SEQ ID 1697, SEQ ID 1698, SEQ ID 1699, SEQ ID 1701, SEQ ID 1703, SEQ ID 1704, SEQ ID 1705, SEQ ID 1706, SEQ ID 1707, SEQ ID 1708, SEQ ID 1709, SEQ ID 1710, SEQ ID 1711, SEQ ID 1712, SEQ ID 1714, SEQ ID 1715, SEQ ID 1716, SEQ ID 1717, SEQ ID 1718, SEQ ID 1719, SEQ ID 1720, SEQ ID 1721, SEQ ID 1722, SEQ ID 1723, SEQ ID 1724, SEQ ID 1725, SEQ ID 1726, SEQ ID 1727, SEQ ID 1728, SEQ ID 1729, SEQ ID 1730, SEQ ID 1731, SEQ ID 1732, SEQ ID 1733, SEQ ID 1734, SEQ ID 1735, SEQ ID 1736, SEQ ID 1737, SEQ ID 1738, SEQ ID 1739, SEQ ID 1740, SEQ ID 1741, SEQ ID 1742, SEQ ID 1743, SEQ ID 1762, SEQ ID 1763, SEQ ID 1764, SEQ ID 1765, SEQ ID 1766, SEQ ID 1767, SEQ ID 1768, SEQ ID 1769, SEQ ID 1770, SEQ ID 1771, SEQ ID 1772, SEQ ID 1773, SEQ ID 1774, SEQ ID 1775, SEQ ID 1776, SEQ ID 1777, SEQ ID 1778, SEQ ID 1779, SEQ ID 1780, SEQ ID 1781, SEQ ID 1782, SEQ ID 1783, SEQ ID 1784, SEQ ID 1785, SEQ ID 1786, SEQ ID 1787, SEQ ID 1788, SEQ ID 1789, SEQ ID 1790, SEQ ID 1791, SEQ ID 1792, SEQ ID 1793, SEQ ID 1794, SEQ ID 1795, SEQ ID 1796, SEQ ID 1797, SEQ ID 1798, SEQ ID 1799, SEQ ID 1800, SEQ ID 1801, SEQ ID 1802, SEQ ID 1803, SEQ ID 1804, SEQ ID 1805, SEQ ID 1806, SEQ ID 1807, SEQ ID 1808, SEQ ID 1809, SEQ ID 1810, SEQ ID 1811, SEQ ID 1812, SEQ ID 1813, SEQ ID 1814, SEQ ID 1815, SEQ ID 1816, SEQ ID 1817, SEQ ID 1818, SEQ ID 1819, SEQ ID 1820, SEQ ID 1821, SEQ ID 1822, SEQ ID 1823, SEQ ID 1824, SEQ ID 1825, SEQ ID 1826, SEQ ID 1832, SEQ ID 1833, SEQ ID 1836, SEQ ID 1837, SEQ ID 1838, SEQ ID 1839, SEQ ID 1840, SEQ ID 1858, SEQ ID 1859, SEQ ID 1860, SEQ ID 1861, SEQ ID 1862, SEQ ID 1863, SEQ ID 1865, SEQ ID 1866, SEQ ID 1868, SEQ ID 1869, SEQ ID 1873, SEQ ID 1877, SEQ ID 1880, SEQ ID 1883, SEQ ID 1884, SEQ ID 1888, SEQ ID 1889, SEQ ID 1890, SEQ ID 1893, SEQ ID 1894, SEQ ID 1895, SEQ ID 1896, SEQ ID 1897, SEQ ID 1898, SEQ ID 1899, SEQ ID 1900, SEQ ID 1902, SEQ ID 1903, SEQ ID 1904, SEQ ID 1906, SEQ ID 1907, SEQ ID 1908, SEQ ID 1910, SEQ ID 1911, SEQ ID 1913, SEQ ID 1914, SEQ ID 1915, SEQ ID 1916, SEQ ID 1918, SEQ ID 1920, SEQ ID 1921, SEQ ID 1922, SEQ ID 1924, SEQ ID 1928, SEQ ID 1929, SEQ ID 1930, SEQ ID 1932, SEQ ID 1933, SEQ ID 1938, SEQ ID 1939, SEQ ID 1940, SEQ ID 1941, SEQ ID 1943, SEQ ID 1944, SEQ ID 1945, SEQ ID 1946, SEQ ID 1948, SEQ ID 1949, SEQ ID 1950, SEQ ID 1952, SEQ ID 1953, SEQ ID 1956, SEQ ID 1957, SEQ ID 1958, SEQ ID 1960, SEQ ID 1962, SEQ ID 1964, SEQ ID 1966, SEQ ID 1967, SEQ ID 1970, SEQ ID 1971, SEQ ID 1972, SEQ ID 1973, SEQ ID 1974, SEQ ID 1975, SEQ ID 1977, SEQ ID 1979, SEQ ID 1981, SEQ ID 1982, SEQ ID 1985, SEQ ID 1986, SEQ ID 1987, SEQ ID 1988, SEQ ID 1989, SEQ ID 1993, SEQ ID 1995, SEQ ID 1996, SEQ ID 1997, SEQ ID 1998, SEQ ID 1999, SEQ ID 2000, SEQ ID 2001, SEQ ID 2002, SEQ ID 2003, SEQ ID 2004, SEQ ID 2005, SEQ ID 2008, SEQ ID 2009, SEQ ID 2010, SEQ ID 2011, SEQ ID 2013, SEQ ID 2014, SEQ ID 2015, SEQ ID 2017, SEQ ID 2019, SEQ ID 2020, SEQ ID 2021, SEQ ID 2023, SEQ ID 2026, SEQ ID 2028, SEQ ID 2031, SEQ ID 2032, SEQ ID 2033, SEQ ID 2035, SEQ ID 2036, SEQ ID 2037, SEQ ID 2038, SEQ ID 2042, SEQ ID 2044, SEQ ID 2048, SEQ ID 2050, SEQ ID 2051, SEQ ID 2052, SEQ ID 2053, SEQ ID 2054, SEQ ID 2055, SEQ ID 2056, SEQ ID 2057, SEQ ID 2058, SEQ ID 2059, SEQ ID 2060, SEQ ID 2061, SEQ ID 2062, SEQ ID 2063, SEQ ID 2064, SEQ ID 2065, SEQ ID 2066, SEQ ID 2067, SEQ ID 2068, SEQ ID 2069, SEQ ID 2070, SEQ ID 2071, SEQ ID 2072, SEQ ID 2073, SEQ ID 2074, SEQ ID 2075, SEQ ID 2076, SEQ ID 2077, SEQ ID 2078, SEQ ID 2079, SEQ ID 2080, SEQ ID 2081, SEQ ID 2082, SEQ ID 2083, SEQ ID 2084, SEQ ID 2085, SEQ ID 2086, SEQ ID 2087, SEQ ID 2088, SEQ ID 2089, SEQ ID 2090, SEQ ID 2091, SEQ ID 2092, SEQ ID 2093, SEQ ID 2094, SEQ ID 2095, SEQ ID 2096, SEQ ID 2097, SEQ ID 2098, SEQ ID 2099, SEQ ID 2101, SEQ ID 2102, SEQ ID 2103, SEQ ID 2104, SEQ ID 2105, SEQ ID 2106, SEQ ID 2107, SEQ ID 2108, SEQ ID 2109, SEQ ID 2110, SEQ ID 2111, SEQ ID 2112, SEQ ID 2113, SEQ ID 2114, SEQ ID 2115, SEQ ID 2116, SEQ ID 2117, SEQ ID 2118, SEQ ID 2119, SEQ ID 2120, SEQ ID 2121, SEQ ID 2122, SEQ ID 2123, SEQ ID 2124, SEQ ID 2125, SEQ ID 2126, SEQ ID 2127, SEQ ID 2146, SEQ ID 2147, SEQ ID 2148, SEQ ID 2149, SEQ ID 2150, SEQ ID 2151, SEQ ID 2152, SEQ ID 2153, SEQ ID 2154, SEQ ID 2155, SEQ ID 2156, SEQ ID 2157, SEQ ID 2158, SEQ ID 2159, SEQ ID 2160, SEQ ID 2161, SEQ ID 2162, SEQ ID 2163, SEQ ID 2164, SEQ ID 2165, SEQ ID 2166, SEQ ID 2167, SEQ ID 2168, SEQ ID 2169, SEQ ID 2170, SEQ ID 2171, SEQ ID 2172, SEQ ID 2173, SEQ ID 2174, SEQ ID 2175, SEQ ID 2176, SEQ ID 2177, SEQ ID 2178, SEQ ID 2179, SEQ ID 2180, SEQ ID 2181, SEQ ID 2182, SEQ ID 2183, SEQ ID 2184, SEQ ID 2185, SEQ ID 2186, SEQ ID 2187, SEQ ID 2188, SEQ ID 2189, SEQ ID 2190, SEQ ID 2191, SEQ ID 2192, SEQ ID 2193, SEQ ID 2194, SEQ ID 2195, SEQ ID 2196, SEQ ID 2197, SEQ ID 2198, SEQ ID 2199, SEQ ID 2200, SEQ ID 2201, SEQ ID 2202, SEQ ID 2203, SEQ ID 2204, SEQ ID 2205, SEQ ID 2206, SEQ ID 2207, SEQ ID 2208, SEQ ID 2209, SEQ ID 2210, SEQ ID 2211, SEQ ID 2212, SEQ ID 2213, SEQ ID 2214, SEQ ID 2216, SEQ ID 2220, SEQ ID 2222, SEQ ID 2223, SEQ ID 2224, SEQ ID 2225, SEQ ID 2239, SEQ ID 2240, SEQ ID 2241, SEQ ID 2242, SEQ ID 2243, SEQ ID 2244, SEQ ID 2245, SEQ ID 2246, SEQ ID 2247, SEQ ID 2248, SEQ ID 2249, SEQ ID 2250, SEQ ID 2251, SEQ ID 2252, SEQ ID 2253, SEQ ID 2254, SEQ ID 2255, SEQ ID 2256, SEQ ID 2257, SEQ ID 2258, SEQ ID 2259, SEQ ID 2260, SEQ ID 2261, SEQ ID 2262, SEQ ID 2263, SEQ ID 2264, SEQ ID 2265, SEQ ID 2266, SEQ ID 2267, SEQ ID 2268, SEQ ID 2269, SEQ ID 2270, SEQ ID 2271, SEQ ID 2272, SEQ ID 2273, SEQ ID 2274, SEQ ID 2275, SEQ ID 2276, SEQ ID 2277, SEQ ID 2278, SEQ ID 2279, SEQ ID 2280, SEQ ID 2281, SEQ ID 2282, SEQ ID 2283, SEQ ID 2284, SEQ ID 2285, SEQ ID 2286, SEQ ID 2287, SEQ ID 2288, SEQ ID 2289, SEQ ID 2290, SEQ ID 2291, SEQ ID 2292, SEQ ID 2293, SEQ ID 2294, SEQ ID 2295, SEQ ID 2296, SEQ ID 2297, SEQ ID 2298, SEQ ID 2299, SEQ ID 2300, SEQ ID 2301, SEQ ID 2302, SEQ ID 2303, SEQ ID 2304, SEQ ID 2305, SEQ ID 2306, SEQ ID 2307, SEQ ID 2308, SEQ ID 2309, SEQ ID 2310, SEQ ID 2311, SEQ ID 2312, SEQ ID 2313, SEQ ID 2314, SEQ ID 2315, SEQ ID 2316, SEQ ID 2317, SEQ ID 2318, SEQ ID 2319, and SEQ ID 2320.

In some embodiments, the antisense oligonucleotide progranulin agonist is selected from the group consisting of SEQ ID 693, SEQ ID 707, SEQ ID 708, SEQ ID 709, SEQ ID 710, SEQ ID 711, SEQ ID 720, SEQ ID 721, SEQ ID 723, SEQ ID 724, SEQ ID 725, SEQ ID 726, SEQ ID 727, SEQ ID 730, SEQ ID 732, SEQ ID 736, SEQ ID 737, SEQ ID 738, SEQ ID 739, SEQ ID 741, SEQ ID 743, SEQ ID 745, SEQ ID 747, SEQ ID 758, SEQ ID 759, SEQ ID 760, SEQ ID 761, SEQ ID 766, SEQ ID 775, SEQ ID 798, SEQ ID 800, SEQ ID 801, SEQ ID 802, SEQ ID 803, SEQ ID 804, SEQ ID 807, SEQ ID 812, SEQ ID 813, SEQ ID 814, SEQ ID 816, SEQ ID 818, SEQ ID 819, SEQ ID 822, SEQ ID 823, SEQ ID 824, SEQ ID 825, SEQ ID 826, SEQ ID 827, SEQ ID 828, SEQ ID 830, SEQ ID 831, SEQ ID 833, SEQ ID 835, SEQ ID 836, SEQ ID 837, SEQ ID 838, SEQ ID 839, SEQ ID 840, SEQ ID 841, SEQ ID 842, SEQ ID 843, SEQ ID 844, SEQ ID 845, SEQ ID 846, SEQ ID 847, SEQ ID 848, SEQ ID 849, SEQ ID 850, SEQ ID 854, SEQ ID 855, SEQ ID 856, SEQ ID 857, SEQ ID 859, SEQ ID 861, SEQ ID 866, SEQ ID 867, SEQ ID 868, SEQ ID 869, SEQ ID 871, SEQ ID 873, SEQ ID 874, SEQ ID 876, SEQ ID 878, SEQ ID 879, SEQ ID 880, SEQ ID 881, SEQ ID 883, SEQ ID 885, SEQ ID 887, SEQ ID 888, SEQ ID 890, SEQ ID 891, SEQ ID 892, SEQ ID 893, SEQ ID 895, SEQ ID 897, SEQ ID 906, SEQ ID 909, SEQ ID 916, SEQ ID 918, SEQ ID 926, SEQ ID 927, SEQ ID 928, SEQ ID 932, SEQ ID 933, SEQ ID 934, SEQ ID 967, SEQ ID 998, SEQ ID 1000, SEQ ID 1001, SEQ ID 1002, SEQ ID 1003, SEQ ID 1005, SEQ ID 1010, SEQ ID 1011, SEQ ID 1012, SEQ ID 1021, SEQ ID 1023, SEQ ID 1024, SEQ ID 1027, SEQ ID 1030, SEQ ID 1037, SEQ ID 1038, SEQ ID 1039, SEQ ID 1041, SEQ ID 1042, SEQ ID 1048, SEQ ID 1049, SEQ ID 1050, SEQ ID 1051, SEQ ID 1054, SEQ ID 1058, SEQ ID 1060, SEQ ID 1061, SEQ ID 1063, SEQ ID 1066, SEQ ID 1070, SEQ ID 1071, SEQ ID 1072, SEQ ID 1073, SEQ ID 1075, SEQ ID 1078, SEQ ID 1081, SEQ ID 1083, SEQ ID 1084, SEQ ID 1085, SEQ ID 1086, SEQ ID 1091, SEQ ID 1092, SEQ ID 1093, SEQ ID 1109, SEQ ID 1111, SEQ ID 1112, SEQ ID 1113, SEQ ID 1114, SEQ ID 1115, SEQ ID 1116, SEQ ID 1117, SEQ ID 1118, SEQ ID 1119, SEQ ID 1120, SEQ ID 1121, SEQ ID 1122, SEQ ID 1123, SEQ ID 1124, SEQ ID 1125, SEQ ID 1126, SEQ ID 1127, SEQ ID 1128, SEQ ID 1129, SEQ ID 1130, SEQ ID 1132, SEQ ID 1135, SEQ ID 1136, SEQ ID 1137, SEQ ID 1138, SEQ ID 1139, SEQ ID 1140, SEQ ID 1141, SEQ ID 1142, SEQ ID 1143, SEQ ID 1144, SEQ ID 1146, SEQ ID 1188, SEQ ID 1189, SEQ ID 1190, SEQ ID 1191, SEQ ID 1192, SEQ ID 1196, SEQ ID 1200, SEQ ID 1201, SEQ ID 1202, SEQ ID 1203, SEQ ID 1204, SEQ ID 1205, SEQ ID 1206, SEQ ID 1207, SEQ ID 1208, SEQ ID 1209, SEQ ID 1223, SEQ ID 1224, SEQ ID 1238, SEQ ID 1243, SEQ ID 1244, SEQ ID 1258, SEQ ID 1259, SEQ ID 1262, SEQ ID 1263, SEQ ID 1264, SEQ ID 1267, SEQ ID 1268, SEQ ID 1271, SEQ ID 1276, SEQ ID 1282, SEQ ID 1283, SEQ ID 1284, SEQ ID 1285, SEQ ID 1286, SEQ ID 1288, SEQ ID 1290, SEQ ID 1291, SEQ ID 1292, SEQ ID 1294, SEQ ID 1297, SEQ ID 1298, SEQ ID 1304, SEQ ID 1311, SEQ ID 1313, SEQ ID 1314, SEQ ID 1315, SEQ ID 1344, SEQ ID 1345, SEQ ID 1346, SEQ ID 1347, SEQ ID 1348, SEQ ID 1349, SEQ ID 1352, SEQ ID 1355, SEQ ID 1357, SEQ ID 1425, SEQ ID 1426, SEQ ID 1427, SEQ ID 1428, SEQ ID 1430, SEQ ID 1431, SEQ ID 1432, SEQ ID 1433, SEQ ID 1434, SEQ ID 1435, SEQ ID 1436, SEQ ID 1437, SEQ ID 1438, SEQ ID 1440, SEQ ID 1441, SEQ ID 1442, SEQ ID 1443, SEQ ID 1444, SEQ ID 1445, SEQ ID 1446, SEQ ID 1447, SEQ ID 1448, SEQ ID 1449, SEQ ID 1450, SEQ ID 1451, SEQ ID 1454, SEQ ID 1455, SEQ ID 1456, SEQ ID 1457, SEQ ID 1460, SEQ ID 1461, SEQ ID 1462, SEQ ID 1463, SEQ ID 1464, SEQ ID 1467, SEQ ID 1469, SEQ ID 1474, SEQ ID 1478, SEQ ID 1480, SEQ ID 1482, SEQ ID 1488, SEQ ID 1492, SEQ ID 1493, SEQ ID 1497, SEQ ID 1498, SEQ ID 1505, SEQ ID 1506, SEQ ID 1507, SEQ ID 1509, SEQ ID 1510, SEQ ID 1512, SEQ ID 1513, SEQ ID 1514, SEQ ID 1515, SEQ ID 1517, SEQ ID 1520, SEQ ID 1524, SEQ ID 1525, SEQ ID 1528, SEQ ID 1529, SEQ ID 1530, SEQ ID 1531, SEQ ID 1532, SEQ ID 1533, SEQ ID 1534, SEQ ID 1535, SEQ ID 1536, SEQ ID 1537, SEQ ID 1538, SEQ ID 1539, SEQ ID 1540, SEQ ID 1541, SEQ ID 1542, SEQ ID 1544, SEQ ID 1545, SEQ ID 1546, SEQ ID 1547, SEQ ID 1548, SEQ ID 1549, SEQ ID 1550, SEQ ID 1551, SEQ ID 1552, SEQ ID 1553, SEQ ID 1554, SEQ ID 1555, SEQ ID 1556, SEQ ID 1558, SEQ ID 1560, SEQ ID 1563, SEQ ID 1565, SEQ ID 1568, SEQ ID 1569, SEQ ID 1575, SEQ ID 1577, SEQ ID 1578, SEQ ID 1579, SEQ ID 1582, SEQ ID 1583, SEQ ID 1584, SEQ ID 1585, SEQ ID 1586, SEQ ID 1587, SEQ ID 1588, SEQ ID 1589, SEQ ID 1590, SEQ ID 1591, SEQ ID 1593, SEQ ID 1594, SEQ ID 1595, SEQ ID 1596, SEQ ID 1599, SEQ ID 1608, SEQ ID 1609, SEQ ID 1610, SEQ ID 1611, SEQ ID 1612, SEQ ID 1613, SEQ ID 1614, SEQ ID 1615, SEQ ID 1616, SEQ ID 1617, SEQ ID 1618, SEQ ID 1620, SEQ ID 1621, SEQ ID 1622, SEQ ID 1623, SEQ ID 1624, SEQ ID 1626, SEQ ID 1630, SEQ ID 1631, SEQ ID 1633, SEQ ID 1635, SEQ ID 1637, SEQ ID 1638, SEQ ID 1639, SEQ ID 1643, SEQ ID 1644, SEQ ID 1645, SEQ ID 1648, SEQ ID 1649, SEQ ID 1651, SEQ ID 1658, SEQ ID 1667, SEQ ID 1669, SEQ ID 1677, SEQ ID 1679, SEQ ID 1681, SEQ ID 1684, SEQ ID 1685, SEQ ID 1686, SEQ ID 1688, SEQ ID 1689, SEQ ID 1690, SEQ ID 1692, SEQ ID 1704, SEQ ID 1707, SEQ ID 1708, SEQ ID 1709, SEQ ID 1710, SEQ ID 1711, SEQ ID 1712, SEQ ID 1714, SEQ ID 1715, SEQ ID 1717, SEQ ID 1718, SEQ ID 1719, SEQ ID 1720, SEQ ID 1721, SEQ ID 1722, SEQ
ID 1723, SEQ ID 1724, SEQ ID 1725, SEQ ID 1726, SEQ
ID 1727, SEQ ID 1728, SEQ ID 1731, SEQ ID 1732, SEQ
ID 1733, SEQ ID 1734, SEQ ID 1735, SEQ ID 1736, SEQ
ID 1737, SEQ ID 1738, SEQ ID 1741, SEQ ID 1742, SEQ
ID 1762, SEQ ID 1764, SEQ ID 1765, SEQ ID 1766, SEQ
ID 1767, SEQ ID 1768, SEQ ID 1769, SEQ ID 1770, SEQ
ID 1771, SEQ ID 1773, SEQ ID 1775, SEQ ID 1776, SEQ
ID 1779, SEQ ID 1780, SEQ ID 1781, SEQ ID 1782, SEQ
ID 1783, SEQ ID 1784, SEQ ID 1785, SEQ ID 1786, SEQ
ID 1787, SEQ ID 1789, SEQ ID 1791, SEQ ID 1792, SEQ
ID 1794, SEQ ID 1795, SEQ ID 1796, SEQ ID 1800, SEQ
ID 1801, SEQ ID 1802, SEQ ID 1804, SEQ ID 1805, SEQ
ID 1806, SEQ ID 1807, SEQ ID 1808, SEQ ID 1809, SEQ
ID 1811, SEQ ID 1812, SEQ ID 1813, SEQ ID 1814, SEQ
ID 1815, SEQ ID 1816, SEQ ID 1817, SEQ ID 1818, SEQ
ID 1819, SEQ ID 1820, SEQ ID 1821, SEQ ID 1822, SEQ
ID 1823, SEQ ID 1824, SEQ ID 1832, SEQ ID 1833, SEQ
ID 1838, SEQ ID 1839, SEQ ID 1840, SEQ ID 1862, SEQ
ID 1866, SEQ ID 1868, SEQ ID 1873, SEQ ID 1877, SEQ
ID 1883, SEQ ID 1884, SEQ ID 1888, SEQ ID 1889, SEQ
ID 1893, SEQ ID 1894, SEQ ID 1928, SEQ ID 1929, SEQ
ID 1933, SEQ ID 1938, SEQ ID 1939, SEQ ID 1940, SEQ
ID 1941, SEQ ID 1943, SEQ ID 1944, SEQ ID 1948, SEQ
ID 1950, SEQ ID 1952, SEQ ID 1956, SEQ ID 1966, SEQ
ID 1985, SEQ ID 1986, SEQ ID 1996, SEQ ID 1997, SEQ
ID 1998, SEQ ID 1999, SEQ ID 2000, SEQ ID 2005, SEQ
ID 2013, SEQ ID 2015, SEQ ID 2020, SEQ ID 2023, SEQ
ID 2026, SEQ ID 2028, SEQ ID 2031, SEQ ID 2032, SEQ
ID 2033, SEQ ID 2042, SEQ ID 2048, SEQ ID 2052, SEQ
ID 2053, SEQ ID 2055, SEQ ID 2056, SEQ ID 2057, SEQ
ID 2058, SEQ ID 2059, SEQ ID 2060, SEQ ID 2061, SEQ
ID 2063, SEQ ID 2065, SEQ ID 2066, SEQ ID 2067, SEQ
ID 2068, SEQ ID 2070, SEQ ID 2072, SEQ ID 2073, SEQ
ID 2075, SEQ ID 2076, SEQ ID 2079, SEQ ID 2080, SEQ
ID 2081, SEQ ID 2082, SEQ ID 2083, SEQ ID 2084, SEQ
ID 2085, SEQ ID 2086, SEQ ID 2087, SEQ ID 2088, SEQ
ID 2089, SEQ ID 2090, SEQ ID 2091, SEQ ID 2092, SEQ
ID 2093, SEQ ID 2094, SEQ ID 2095, SEQ ID 2097, SEQ
ID 2116, SEQ ID 2119, SEQ ID 2120, SEQ ID 2121, SEQ
ID 2122, SEQ ID 2123, SEQ ID 2124, SEQ ID 2125, SEQ
ID 2126, SEQ ID 2127, SEQ ID 2146, SEQ ID 2147, SEQ
ID 2148, SEQ ID 2158, SEQ ID 2160, SEQ ID 2162, SEQ
ID 2163, SEQ ID 2165, SEQ ID 2166, SEQ ID 2167, SEQ
ID 2168, SEQ ID 2169, SEQ ID 2170, SEQ ID 2171, SEQ
ID 2172, SEQ ID 2173, SEQ ID 2174, SEQ ID 2175, SEQ
ID 2176, SEQ ID 2177, SEQ ID 2181, SEQ ID 2182, SEQ
ID 2183, SEQ ID 2184, SEQ ID 2185, SEQ ID 2186, SEQ
ID 2187, SEQ ID 2193, SEQ ID 2194, SEQ ID 2195, SEQ
ID 2196, SEQ ID 2197, SEQ ID 2198, SEQ ID 2199, SEQ
ID 2200, SEQ ID 2202, SEQ ID 2203, SEQ ID 2204, SEQ
ID 2206, SEQ ID 2208, SEQ ID 2209, SEQ ID 2210, SEQ
ID 2211, SEQ ID 2212, SEQ ID 2213, SEQ ID 2214, SEQ
ID 2216, SEQ ID 2222, SEQ ID 2224, SEQ ID 2239, SEQ
ID 2240, SEQ ID 2242, SEQ ID 2243, SEQ ID 2244, SEQ
ID 2245, SEQ ID 2246, SEQ ID 2247, SEQ ID 2248, SEQ
ID 2251, SEQ ID 2252, SEQ ID 2253, SEQ ID 2254, SEQ
ID 2255, SEQ ID 2256, SEQ ID 2257, SEQ ID 2258, SEQ
ID 2259, SEQ ID 2260, SEQ ID 2261, SEQ ID 2262, SEQ
ID 2263, SEQ ID 2264, SEQ ID 2265, SEQ ID 2266, SEQ
ID 2267, SEQ ID 2268, SEQ ID 2269, SEQ ID 2280, SEQ
ID 2281, SEQ ID 2282, SEQ ID 2283, SEQ ID 2284, SEQ
ID 2285, SEQ ID 2294, SEQ ID 2295, SEQ ID 2302, SEQ
ID 2307, SEQ ID 2308, SEQ ID 2309, SEQ ID 2310, SEQ
ID 2311, SEQ ID 2312, SEQ ID 2316, SEQ ID 2317, SEQ
ID 2318, SEQ ID 2319, and SEQ ID 2320.

The invention provides for a conjugate comprising the antisense oligonucleotide progranulin agonist according to the invention, and at least one conjugate moiety covalently attached to said antisense oligonucleotide progranulin agonist.

The invention provides an antisense oligonucleotide progranulin agonist covalently attached to at least one conjugate moiety.

The invention provides for a pharmaceutically acceptable salt of the antisense oligonucleotide progranulin agonist according to the invention, or the conjugate according to the invention.

The invention provides for an antisense oligonucleotide progranulin agonist according to the invention wherein the antisense oligonucleotide progranulin agonist is in the form of a pharmaceutically acceptable salt. In some embodiments the pharmaceutically acceptable salt may be a sodium salt or a potassium salt.

The invention provides for a pharmaceutically acceptable sodium salt of the antisense oligonucleotide progranulin agonist according to the invention, or the conjugate according to the invention.

The invention provides for a pharmaceutically acceptable potassium salt of the antisense oligonucleotide progranulin agonist according to the invention, or the conjugate according to the invention.

The invention provides for a pharmaceutical composition comprising the antisense oligonucleotide progranulin agonist of the invention, or the conjugate of the invention, and a pharmaceutically acceptable diluent, solvent, carrier, salt and/or adjuvant.

The invention provides for a pharmaceutical composition comprising the antisense oligonucleotide progranulin agonist of the invention, or the conjugate of the invention, and a pharmaceutically acceptable salt. For example, the salt may comprise a metal cation, such as a sodium salt or a potassium salt.

The invention provides for a pharmaceutical composition according to the invention, wherein the pharmaceutical composition comprises the antisense oligonucleotide progranulin agonist of the invention or the conjugate of the invention, or the pharmaceutically acceptable salt of the invention; and an aqueous diluent or solvent.

The invention provides for a solution, such as a phosphate buffered saline solution of the antisense oligonucleotide progranulin agonist of the invention, or the conjugate of the invention, or the pharmaceutically acceptable salt of the invention. Suitably the solution, such as phosphate buffered saline solution, of the invention, is a sterile solution.

The invention provides for a method for enhancing the expression of progranulin in a cell which is expressing progranulin, said method comprising administering an antisense oligonucleotide progranulin agonist of the invention or the conjugate of the invention, or the salt according to the invention, or the pharmaceutical composition according to the invention in an effective amount to said cell. In some embodiments the method is an in vitro method. In some embodiments the method is an in vivo method.

In some embodiments, the cell is either a human cell or a mammalian cell.

The invention provides for a method for treating or preventing neurological disease, comprising administering a therapeutically or prophylactically effective amount of an antisense oligonucleotide progranulin agonist of the invention or the conjugate of the invention, or the salt of the invention, or the pharmaceutical composition of the invention to a subject suffering from or susceptible to neurological disease. In one embodiment the neurological disease may be a TDP-43 pathology.

The invention provides for a method for treating progranulin haploinsufficiency disease, comprising administering a therapeutically or prophylactically effective amount of an antisense oligonucleotide progranulin agonist of the invention or the conjugate of the invention, or the salt of the invention, or the pharmaceutical composition of the invention to a subject suffering from progranulin haploinsufficiency or a related disorder.

The invention provides for an antisense oligonucleotide progranulin agonist, for use as a medicament.

The invention provides for an antisense oligonucleotide progranulin agonist, for use in therapy.

The invention provides for the antisense oligonucleotide progranulin agonist of the invention or the conjugate of the invention, or the salt of the invention, or the pharmaceutical composition of the invention, for use as a medicament.

The invention provides an antisense oligonucleotide progranulin agonist of the invention or the conjugate of the invention, or the salt according to the invention, or the pharmaceutical composition according to the invention for use in therapy.

The invention provides for an antisense oligonucleotide progranulin agonist of the invention or the conjugate according to the invention, or the salt according to the invention, or the pharmaceutical composition according to the invention for use in the treatment of a neurological disease. In one embodiment the neurological disease may be a TDP-43 pathology.

The invention provides for an antisense oligonucleotide progranulin agonist of the invention or the conjugate according to the invention, or the salt according to the invention, or the pharmaceutical composition according to the invention for use in the treatment of progranulin haploinsufficiency, or a related disorder.

The invention provides for the use of an antisense oligonucleotide progranulin agonist of the invention or the conjugate according to the invention, or the salt according to the invention, or the pharmaceutical composition according to the invention, for the preparation of a medicament for treatment or prevention of a neurological disease In one embodiment the neurological disease may be a TDP-43 pathology.

The invention provides for the use of the antisense oligonucleotide progranulin agonist of the invention or the conjugate according to the invention, or the salt according to the invention, or the pharmaceutical composition according to the invention, for the preparation of a medicament for treatment of progranulin haploinsufficiency or a related disorder.

In some embodiments the method or use of the invention is for the treatment of fronto temporal dementia (FTD), neuropathologic frontotemporal lobar degeneration or neuroinflammation. In other embodiments the method or use of the invention is for the treatment of amyotrophic lateral sclerosis (ALS), Alzheimer's disease, Parkinson's disease, Autism, Hippocampal sclerosis dementia, Down syndrome, Huntington's disease, polyglutamine diseases, spinocerebellar ataxia 3, myopathies or Chronic Traumatic Encephalopathy.

In one aspect the invention includes an oligonucleotide progranulin agonist having the structure:

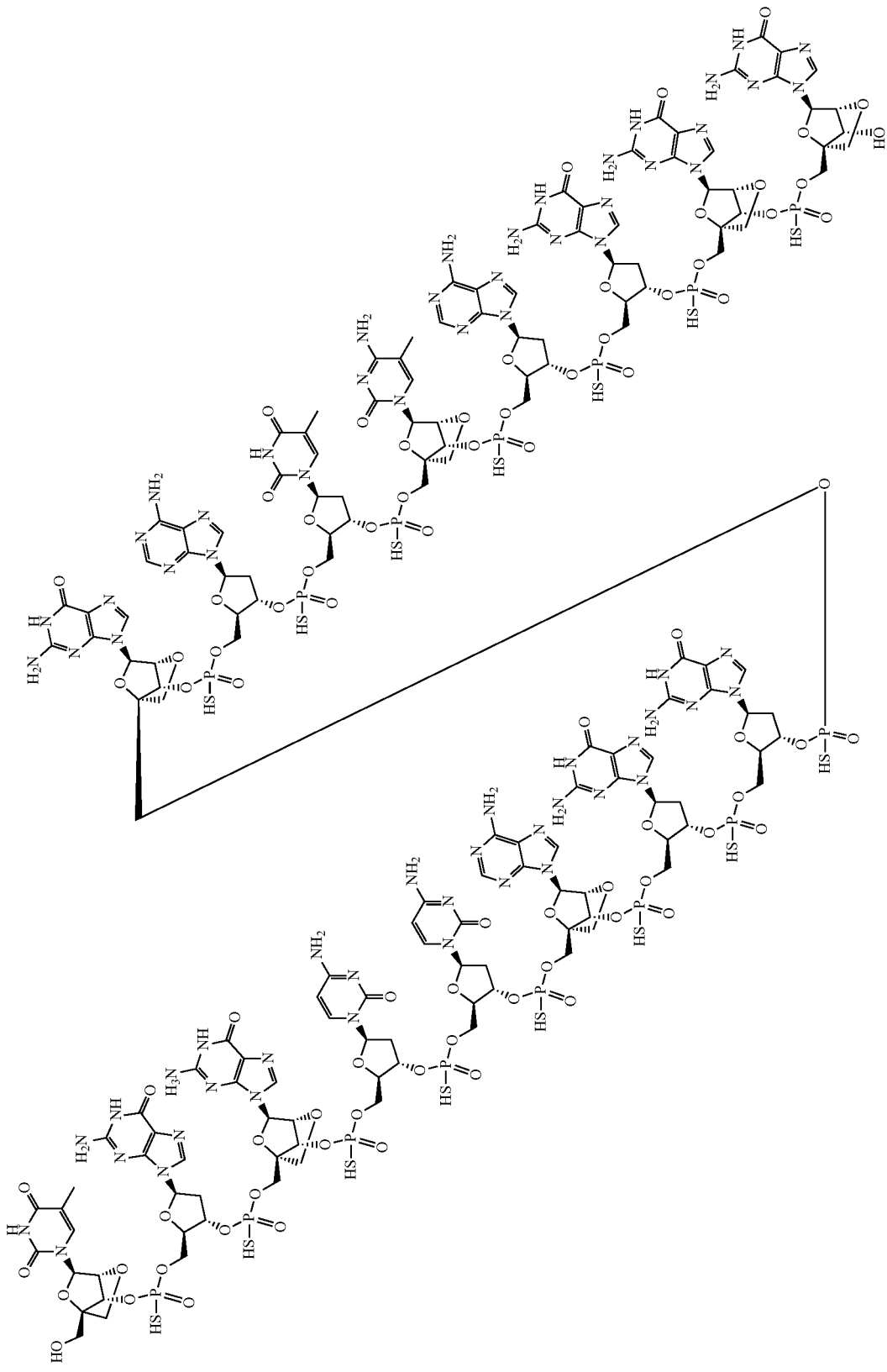

The invention also includes an antisense oligonucleotide progranulin agonist wherein the oligonucleotide is the oligonucleotide compound TgGccAggGatCagGG (SEQ ID NO: 106) wherein capital letters represent beta-D-oxy LNA nucleosides, lowercase letters represent DNA nucleosides, all LNA C are 5-methyl cytosine, and all internucleoside linkages are phosphorothioate internucleoside linkages.

BRIEF DESCRIPTION OF FIGURES

FIG. 2 shows localization of compounds #105, #106, #110 and #114 to the 5' UTR of the proganulin mature mRNA transcript, targeting the uORF region.

DEFINITIONS

Progranulin Agonist

Figure 1:
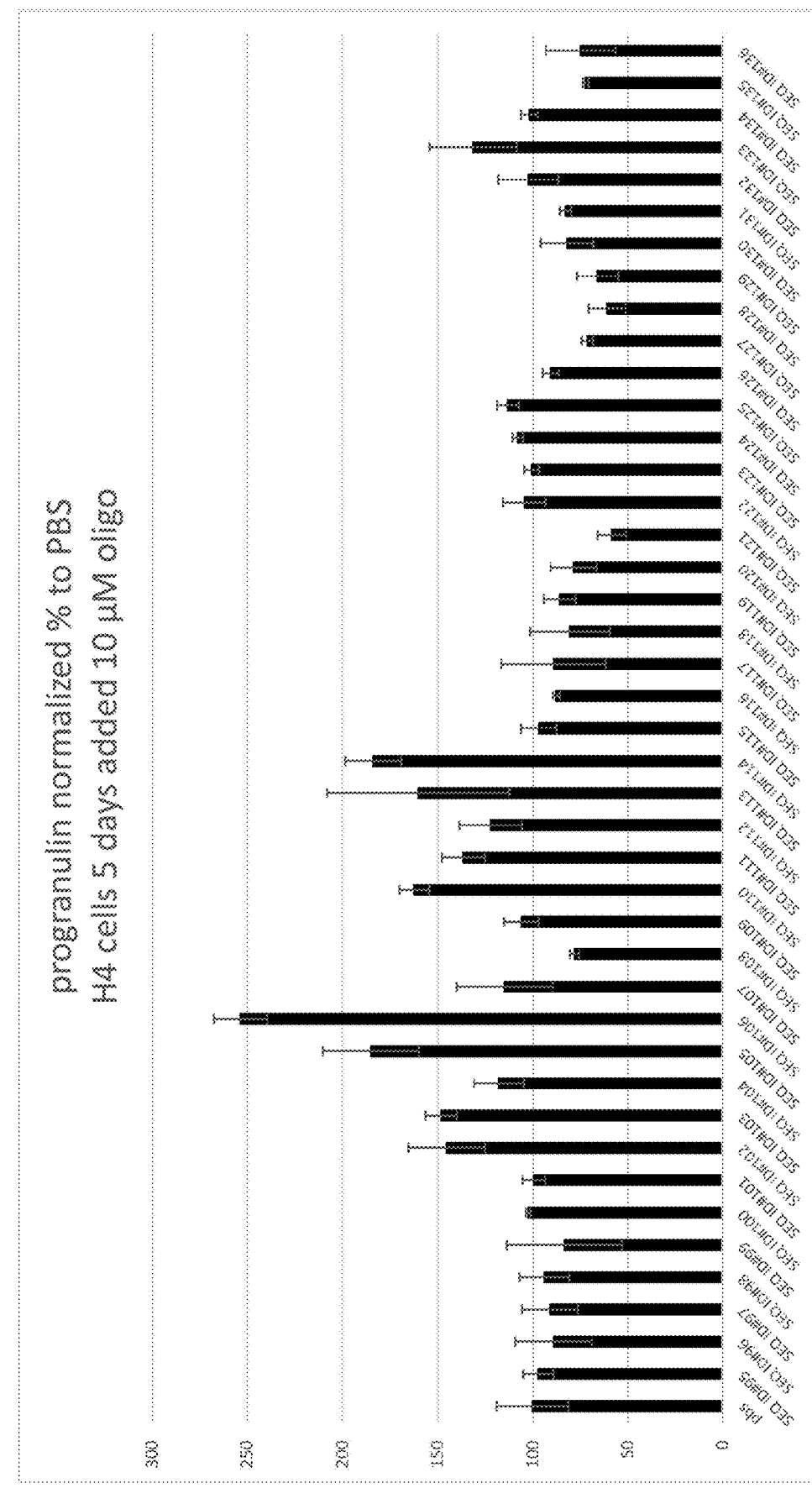
FIG. 1 shows progranulin expression levels in H4 neuroglioma cells following 5 days of treatment with 16-mer oligos targeting the progranulin 5' UTR uORF region. Progranulin expression levels were evaluated in media after dilution 1:8 by ELISA from Abcam (ab252364).

The term "progranulin agonist" as used herein refers to a compound which is capable of enhancing the expression of progranulin transcripts and/or protein in a cell which is expressing progranulin.

TDP-43 Pathologies

A TDP-43 pathology is a disease which is associated with reduced or aberrant expression of TDP-43, often associated with an increase in cytoplasmic TDP-43, particularly hyperphosphorylated and ubiquitinated TDP-43.

Diseases associated with TDP-43 pathology include amyotrophic lateral sclerosis (ALS), frontotemporal lobar degeneration (FTLD), Alzheimer's disease, Parkinson's disease, Autism, Hippocampal sclerosis dementia, Down syndrome, Huntington's disease, polyglutamine diseases, such as spinocerebellar ataxia 3, myopathies and Chronic Traumatic Encephalopathy.

Oligonucleotide

The term "oligonucleotide" as used herein is defined as it is generally understood by the skilled person as a molecule comprising two or more covalently linked nucleosides. Such covalently bound nucleosides may also be referred to as nucleic acid molecules or oligomers.

Oligonucleotides are commonly made in the laboratory by solid-phase chemical synthesis followed by purification and isolation. When referring to a sequence of the oligonucleotide, reference is made to the sequence or order of nucleobase moieties, or modifications thereof, of the covalently linked nucleotides or nucleosides. The oligonucleotides of the invention are man-made, and are chemically synthesized, and are typically purified or isolated. The oligonucleotides of the invention may comprise one or more modified nucleosides such as 2' sugar modified nucleosides. The oligonucleotides of the invention may comprise one or more modified internucleoside linkages, such as one or more phosphorothioate internucleoside linkages.

Antisense Oligonucleotides

The term "antisense oligonucleotide" as used herein is defined as an oligonucleotide capable of modulating expression of a target gene by hybridizing to a target nucleic acid, in particular to a contiguous sequence on a target nucleic acid. Antisense oligonucleotides are not essentially double stranded and are therefore not siRNAs or shRNAs. The antisense oligonucleotides of the present invention may be single stranded. It is understood that single stranded oligonucleotides of the present invention can form hairpins or intermolecular duplex structures (duplex between two molecules of the same oligonucleotide), as long as the degree of intra or inter self-complementarity is less than approximately 50% across of the full length of the oligonucleotide.

In some embodiments, the single stranded antisense oligonucleotides of the invention may not contain RNA nucleosides.

Advantageously, the antisense oligonucleotides of the invention comprise one or more modified nucleosides or nucleotides, such as 2' sugar modified nucleosides. Furthermore, in some antisense oligonucleotides of the invention, it may be advantageous that the nucleosides which are not modified are DNA nucleosides.

Contiguous Nucleotide Sequence

The term "contiguous nucleotide sequence" refers to the region of the oligonucleotide which is complementary to a target nucleic acid, which may be or may comprise an oligonucleotide motif sequence. The term is used interchangeably herein with the term "contiguous nucleobase sequence". In some embodiments all the nucleosides of the oligonucleotide constitute the contiguous nucleotide sequence. The contiguous nucleotide sequence is the sequence of nucleotides in the oligonucleotide of the invention which are complementary to, and in some instances fully complementary to, the target nucleic acid or target sequence, or target site sequence.

In some embodiments the target sequence is SEQ ID NO 2.

SEQ ID NO 2:
TAGCCCTGATCCCTGGCCAATGGAAACTGAGGTAGG

In some embodiments the target sequence is selected from the group consisting of SEQ ID NO 343-682.

In some embodiments the target sequence is nucleotides 38-246 of SEQ ID NO 1.

In some embodiments the target sequence is selected from the group consisting of SEQ ID NO 568, SEQ ID NO 571, SEQ ID NO 575, SEQ ID NO 576, SEQ ID NO 577, SEQ ID NO 578, SEQ ID NO 584 & SEQ ID NO 586.

In some embodiments the target sequence is SEQ ID NO 683.

SEQ ID NO 683 = TGGCCAATGGAAACTGAGGTAGG

In some embodiments the target sequence is SEQ ID NO 684.

SEQ ID NO 684 = CCCTAGCACCTCCCCCTAACCAAATTCTCCCTG

In some embodiments the target sequence is SEQ ID NO 685.

SEQ ID NO 685 = CCCATTCTGAGCTCCCCATCA

In some embodiments the target sequence is SEQ ID NO 686.

SEQ ID NO 686 = AGGGGGTTGTGGCAAAAGCCA

In some embodiments the target sequence is SEQ ID NO 687.

SEQ ID NO 687 = CCATCCCCTCCCCGTTTCAGT

In some embodiments the target sequence is SEQ ID NO 688.

SEQ ID NO 688 = ATCCACAGGGGTGTTTGT

In some embodiments the target sequence is SEQ ID NO 689.

SEQ ID NO 689 = TAAGTAGCCAATGGGAGCGGGTAGCCCTGATCCC TGGCCAATGGAAACTGAGGTAGG

SEQ ID NO 689 is in the human progranulin mature mRNA 5' UTR from position 119 to 158 according to RefSeq NM_002087 (SEQ ID NO 1), as targeted by SEQ ID NOs 207 to 246 and identified herein as an advantageous region to target for progranulin agonist activity.

In some embodiments the target sequence is nucleotides 2039-2346 of SEQ ID NO 1.

In some embodiments the target sequence is selected from the group consisting of SEQ ID NO 684, SEQ ID NO 685, SEQ ID NO 683, SEQ ID NO 686, SEQ ID NO 687, and SEQ ID NO 688.

In some embodiments the target sequence is selected from the group consisting of SEQ ID NO 607, SEQ ID NO 608, SEQ ID NO 609, SEQ ID NO 610, SEQ ID NO 611, SEQ ID NO 612, SEQ ID NO 619, SEQ ID NO 620, SEQ ID NO 633, SEQ ID NO 640, SEQ ID NO 641, SEQ ID NO 645, SEQ ID NO 651, and SEQ ID NO 652.

In some embodiments the target sequence is selected from the group consisting of SEQ ID NO 2040-3386.

In some embodiments the target sequence is selected from the group consisting of SEQ ID 2321, SEQ ID 2322, SEQ ID 2324, SEQ ID 2328, SEQ ID 2329, SEQ ID 2331, SEQ ID 2334, SEQ ID 2335, SEQ ID 2336, SEQ ID 2337, SEQ ID 2338, SEQ ID 2339, SEQ ID 2340, SEQ ID 2341, SEQ ID 2342, SEQ ID 2345, SEQ ID 2346, SEQ ID 2347, SEQ ID 2348, SEQ ID 2349, SEQ ID 2350, SEQ ID 2351, SEQ ID 2352, SEQ ID 2353, SEQ ID 2354, SEQ ID 2355, SEQ ID 2356, SEQ ID 2357, SEQ ID 2358, SEQ ID 2359, SEQ ID 2360, SEQ ID 2361, SEQ ID 2362, SEQ ID 2364, SEQ ID 2365, SEQ ID 2366, SEQ ID 2367, SEQ ID 2368, SEQ ID 2369, SEQ ID 2370, SEQ ID 2371, SEQ ID 2372, SEQ ID 2373, SEQ ID 2374, SEQ ID 2375, SEQ ID 2376, SEQ ID 2377, SEQ ID 2378, SEQ ID 2379, SEQ ID 2380, SEQ ID 2381, SEQ ID 2384, SEQ ID 2386, SEQ ID 2387, SEQ ID 2388, SEQ ID 2389, SEQ ID 2390, SEQ ID 2392, SEQ ID 2393, SEQ ID 2394, SEQ ID 2395, SEQ ID 2396, SEQ ID 2397, SEQ ID 2398, SEQ ID 2399, SEQ ID 2400, SEQ ID 2401, SEQ ID 2403, SEQ ID 2404, SEQ ID 2405, SEQ ID 2406, SEQ ID 2407, SEQ ID 2408, SEQ ID 2410, SEQ ID 2411, SEQ ID 2413, SEQ ID 2414, SEQ ID 2415, SEQ ID 2416, SEQ ID 2418, SEQ ID 2419, SEQ ID 2421, SEQ ID 2424, SEQ ID 2425, SEQ ID 2426, SEQ ID 2427, SEQ ID 2428, SEQ ID 2429, SEQ ID 2430, SEQ ID 2431, SEQ ID 2432, SEQ ID 2433, SEQ ID 2434, SEQ ID 2435, SEQ ID 2436, SEQ ID 2437, SEQ ID 2438, SEQ ID 2439, SEQ ID 2440, SEQ ID 2441, SEQ ID 2442, SEQ ID 2443, SEQ ID 2444, SEQ ID 2445, SEQ ID 2446, SEQ ID 2447, SEQ ID 2448, SEQ ID 2449, SEQ ID 2450, SEQ ID 2451, SEQ ID 2452, SEQ ID 2453, SEQ ID 2454, SEQ ID 2455, SEQ ID 2456, SEQ ID 2457, SEQ ID 2458, SEQ ID 2459, SEQ ID 2460, SEQ ID 2461, SEQ ID 2462, SEQ ID 2463, SEQ ID 2464, SEQ ID 2465, SEQ ID 2466, SEQ ID 2467, SEQ ID 2468, SEQ ID 2469, SEQ ID 2470, SEQ ID 2471, SEQ ID 2472, SEQ ID 2473, SEQ ID 2474, SEQ ID 2475, SEQ ID 2476, SEQ ID 2477, SEQ ID 2478, SEQ ID 2479, SEQ ID 2481, SEQ ID 2482, SEQ ID 2483, SEQ ID 2484, SEQ ID 2485, SEQ ID 2487, SEQ ID 2489, SEQ ID 2490, SEQ ID 2491, SEQ ID 2492, SEQ ID 2493, SEQ ID 2494, SEQ ID 2495, SEQ ID 2496, SEQ ID 2497, SEQ ID 2498, SEQ ID 2499, SEQ ID 2501, SEQ ID 2502, SEQ ID 2503, SEQ ID 2504, SEQ ID 2505, SEQ ID 2506, SEQ ID 2507, SEQ ID 2508, SEQ ID 2509, SEQ ID 2510, SEQ ID 2511, SEQ ID 2512, SEQ ID 2513, SEQ ID 2514, SEQ ID 2515, SEQ ID 2516, SEQ ID 2518, SEQ ID 2519, SEQ ID 2520, SEQ ID 2521, SEQ ID 2522, SEQ ID 2523, SEQ ID 2524, SEQ ID 2525, SEQ ID 2526, SEQ ID 2527, SEQ ID 2528, SEQ ID 2531, SEQ ID 2533, SEQ ID 2534, SEQ ID 2535, SEQ ID 2536, SEQ ID 2537, SEQ ID 2538, SEQ ID 2540, SEQ ID 2541, SEQ ID 2542, SEQ ID 2544, SEQ ID 2546, SEQ ID 2547, SEQ ID 2549, SEQ ID 2550, SEQ ID 2551, SEQ ID 2553, SEQ ID 2554, SEQ ID 2555, SEQ ID 2556, SEQ ID 2557, SEQ ID 2560, SEQ ID 2561, SEQ ID 2562, SEQ ID 2563, SEQ ID 2565, SEQ ID 2566, SEQ ID 2567, SEQ ID 2572, SEQ ID 2573, SEQ ID 2574, SEQ ID 2575, SEQ ID 2576, SEQ ID 2577, SEQ ID 2578, SEQ ID 2579, SEQ ID 2580, SEQ ID 2581, SEQ ID 2582, SEQ ID 2583, SEQ ID 2584, SEQ ID 2585, SEQ ID 2586, SEQ ID 2588, SEQ ID 2589, SEQ ID 2590, SEQ ID 2591, SEQ ID 2592, SEQ ID 2593, SEQ ID 2594, SEQ ID 2595, SEQ ID 2596, SEQ ID 2597, SEQ ID 2598, SEQ ID 2599, SEQ ID 2601, SEQ ID 2602, SEQ ID 2603, SEQ ID 2604, SEQ ID 2606, SEQ ID 2610, SEQ ID 2613, SEQ ID 2614, SEQ ID 2615, SEQ ID 2619, SEQ ID 2622, SEQ ID 2623, SEQ ID 2624, SEQ ID 2625, SEQ ID 2626, SEQ ID 2627, SEQ ID 2628, SEQ ID 2629, SEQ ID 2630, SEQ ID 2631, SEQ ID 2632, SEQ ID 2633, SEQ ID 2634, SEQ ID 2635, SEQ ID 2636, SEQ ID 2637, SEQ ID 2638, SEQ ID 2639, SEQ ID 2640, SEQ ID 2641, SEQ ID 2642, SEQ ID 2643, SEQ ID 2644, SEQ ID 2645, SEQ ID 2646, SEQ ID 2647, SEQ ID 2648, SEQ ID 2649, SEQ ID 2650, SEQ ID 2651, SEQ ID 2652, SEQ ID 2653, SEQ ID 2654, SEQ ID 2655, SEQ ID 2656, SEQ ID 2658, SEQ ID 2659, SEQ ID 2660, SEQ ID 2661, SEQ ID 2662, SEQ ID 2663, SEQ ID 2664, SEQ ID 2665, SEQ ID 2666, SEQ ID 2667, SEQ ID 2668, SEQ ID 2669, SEQ ID 2670, SEQ ID 2671, SEQ ID 2672, SEQ ID 2673, SEQ ID 2674, SEQ ID 2675, SEQ ID 2676, SEQ ID 2677, SEQ ID 2678, SEQ ID 2679, SEQ ID 2680, SEQ ID 2681, SEQ ID 2682, SEQ ID 2683, SEQ ID 2684, SEQ ID 2685, SEQ ID 2686, SEQ ID 2687, SEQ ID 2688, SEQ ID 2689, SEQ ID 2690, SEQ ID 2691, SEQ ID 2693, SEQ ID 2694, SEQ ID 2695, SEQ ID 2696, SEQ ID 2697, SEQ ID 2698, SEQ ID 2699, SEQ ID 2700, SEQ ID 2701, SEQ ID 2702, SEQ ID 2703, SEQ ID 2704, SEQ ID 2705, SEQ ID 2706, SEQ ID 2707, SEQ ID 2708, SEQ ID 2709, SEQ ID 2710, SEQ ID 2711, SEQ ID 2712, SEQ ID 2713, SEQ ID 2714, SEQ ID 2715, SEQ ID 2716, SEQ ID 2717, SEQ ID 2718, SEQ ID 2719, SEQ ID 2720, SEQ ID 2721, SEQ ID 2722, SEQ ID 2723, SEQ ID 2726, SEQ ID 2727, SEQ ID 2728, SEQ ID 2729, SEQ ID 2730, SEQ ID 2733, SEQ ID 2734, SEQ ID 2735, SEQ ID 2736, SEQ ID 2737, SEQ ID 2738, SEQ ID 2739, SEQ ID 2740, SEQ ID 2741, SEQ ID 2742, SEQ ID 2743, SEQ ID 2744, SEQ ID 2745, SEQ ID 2746, SEQ ID 2747, SEQ ID 2748, SEQ ID 2749, SEQ ID 2750, SEQ ID 2751, SEQ ID 2752, SEQ ID 2753, SEQ ID 2754, SEQ ID 2755, SEQ ID 2756, SEQ ID 2757, SEQ ID 2758, SEQ ID 2759, SEQ ID 2760, SEQ ID 2761, SEQ ID 2762, SEQ ID 2763, SEQ ID 2764, SEQ ID 2765, SEQ ID 2766, SEQ ID 2767, SEQ ID 2768, SEQ ID 2769, SEQ ID 2770, SEQ ID 2771, SEQ ID 2772, SEQ ID 2773, SEQ ID 2774, SEQ ID 2775, SEQ ID 2815, SEQ ID 2816, SEQ ID 2817, SEQ ID 2818, SEQ ID 2819, SEQ ID 2820, SEQ ID 2821, SEQ ID 2822, SEQ ID 2823, SEQ ID 2824, SEQ ID 2825, SEQ ID 2826, SEQ ID 2827, SEQ ID 2828, SEQ ID 2829, SEQ ID 2830, SEQ ID 2831, SEQ ID 2832, SEQ ID 2833, SEQ ID 2834, SEQ ID 2835, SEQ ID 2836, SEQ ID 2837, SEQ ID 2838, SEQ ID 2839, SEQ ID 2840, SEQ ID 2841, SEQ ID 2842, SEQ ID 2843, SEQ ID 2844, SEQ ID 2845, SEQ ID 2847, SEQ ID 2848, SEQ ID 2849, SEQ ID 2850, SEQ ID 2851, SEQ ID 2852, SEQ ID 2853, SEQ ID 2854, SEQ ID 2855, SEQ ID 2858, SEQ ID 2859, SEQ ID 2860, SEQ ID 2861, SEQ ID 2862, SEQ ID 2863, SEQ ID 2864, SEQ ID 2865, SEQ ID 2866, SEQ ID 2867, SEQ ID 2868, SEQ ID 2869, SEQ ID 2870, SEQ ID 2871, SEQ ID 2872, SEQ ID 2873, SEQ ID 2874, SEQ ID 2875, SEQ ID 2876, SEQ ID 2878, SEQ ID 2879, SEQ ID 2880, SEQ ID 2881, SEQ ID 2882, SEQ ID 2883, SEQ ID 2884, SEQ ID 2885, SEQ ID 2886, SEQ ID 2887, SEQ ID 2888, SEQ ID 2889, SEQ ID 2890, SEQ ID 2891, SEQ ID 2892, SEQ ID 2893, SEQ ID 2894, SEQ ID 2895, SEQ ID 2896, SEQ ID 2897, SEQ ID 2898, SEQ ID 2899, SEQ ID 2900, SEQ ID 2901, SEQ ID 2902, SEQ ID 2903, SEQ ID 2904, SEQ ID 2905, SEQ ID 2906, SEQ ID 2907, SEQ ID 2908, SEQ ID 2909, SEQ ID 2910, SEQ ID 2911, SEQ ID 2912, SEQ ID 2913, SEQ ID 2914, SEQ ID 2915, SEQ ID 2916, SEQ ID 2917, SEQ ID 2918, SEQ ID 2919, SEQ ID 2920, SEQ ID 2921, SEQ ID 2922, SEQ ID 2923, SEQ ID 2924, SEQ ID 2925, SEQ ID 2926, SEQ ID 2927, SEQ ID 2928, SEQ ID 2929, SEQ ID 2930, SEQ ID 2931, SEQ ID 2932, SEQ ID 2934, SEQ ID 2935, SEQ ID 2936, SEQ ID 2937, SEQ ID 2938, SEQ ID 2939, SEQ ID 2940, SEQ ID 2941, SEQ ID 2942, SEQ ID 2943, SEQ ID 2944, SEQ ID 2945, SEQ ID 2946, SEQ ID 2947, SEQ ID 2948, SEQ ID 2949, SEQ ID 2950, SEQ ID 2951, SEQ ID 2953, SEQ ID 2954, SEQ ID 2955, SEQ ID 2956, SEQ ID 2957, SEQ ID 2958, SEQ ID 2960, SEQ ID 2961, SEQ ID 2963, SEQ ID 2964, SEQ ID 2965, SEQ ID 2966, SEQ ID 2967, SEQ ID 2969, SEQ ID 2970, SEQ ID 2971, SEQ ID 2972, SEQ ID 2973, SEQ ID 2974, SEQ ID 2975, SEQ ID 2976, SEQ ID 2977, SEQ ID 2978, SEQ ID 2979, SEQ ID 2980, SEQ ID 2981, SEQ ID 2982, SEQ ID 2983, SEQ ID 2984, SEQ ID 2985, SEQ ID 3053, SEQ ID 3054, SEQ ID 3055, SEQ ID 3056, SEQ ID 3057, SEQ ID 3058, SEQ ID 3059, SEQ ID 3060, SEQ ID 3061, SEQ ID 3062, SEQ ID 3063, SEQ ID 3064, SEQ ID 3065, SEQ ID 3066, SEQ ID 3068, SEQ ID 3069, SEQ ID 3070, SEQ ID 3071, SEQ ID 3072, SEQ ID 3073, SEQ ID 3074, SEQ ID 3075, SEQ ID 3076, SEQ ID 3077, SEQ ID 3078, SEQ ID 3079, SEQ ID 3080, SEQ ID 3081, SEQ ID 3082, SEQ ID 3083, SEQ ID 3084, SEQ ID 3085, SEQ ID 3086, SEQ ID 3087, SEQ ID 3088, SEQ ID 3089, SEQ ID 3090, SEQ ID 3091, SEQ ID 3092, SEQ ID 3093, SEQ ID 3094, SEQ ID 3095, SEQ ID 3097, SEQ ID 3098, SEQ ID 3099, SEQ ID 3100, SEQ ID 3102, SEQ ID 3103, SEQ ID 3104, SEQ ID 3105, SEQ ID 3106, SEQ ID 3107, SEQ ID 3108, SEQ ID 3109, SEQ ID 3110, SEQ ID 3112, SEQ ID 3113, SEQ ID 3115, SEQ ID 3116, SEQ ID 3117, SEQ ID 3119, SEQ ID 3120, SEQ ID 3121, SEQ ID 3122, SEQ ID 3123, SEQ ID 3124, SEQ ID 3125, SEQ ID 3126, SEQ ID 3127, SEQ ID 3128, SEQ ID 3129, SEQ ID 3130, SEQ ID 3131, SEQ ID 3132, SEQ ID 3133, SEQ ID 3134, SEQ ID 3135, SEQ ID 3136, SEQ ID 3137, SEQ ID 3138, SEQ ID 3139, SEQ ID 3140, SEQ ID 3141, SEQ ID 3142, SEQ ID 3143, SEQ ID 3144, SEQ ID 3145, SEQ ID 3146, SEQ ID 3147, SEQ ID 3148, SEQ ID 3149, SEQ ID 3150, SEQ ID 3151, SEQ ID 3152, SEQ ID 3153, SEQ ID 3154, SEQ ID 3155, SEQ ID 3156, SEQ ID 3157, SEQ ID 3158, SEQ ID 3159, SEQ ID 3160, SEQ ID 3161, SEQ ID 3162, SEQ ID 3163, SEQ ID 3164, SEQ ID 3165, SEQ ID 3166, SEQ ID 3167, SEQ ID 3168, SEQ ID 3169, SEQ ID 3170, SEQ ID 3171, SEQ ID 3172, SEQ ID 3173, SEQ ID 3174, SEQ ID 3175, SEQ ID 3176, SEQ ID 3177, SEQ ID 3178, SEQ ID 3179, SEQ ID 3180, SEQ ID 3181, SEQ ID 3182, SEQ ID 3183, SEQ ID 3184, SEQ ID 3185, SEQ ID 3186, SEQ ID 3187, SEQ ID 3188, SEQ ID 3189, SEQ ID 3190, SEQ ID 3191, SEQ ID 3192, SEQ ID 3193, SEQ ID 3194, SEQ ID 3195, SEQ ID 3196, SEQ ID 3197, SEQ ID 3198, SEQ ID 3199, SEQ ID 3200, SEQ ID 3201, SEQ ID 3202, SEQ ID 3203, SEQ ID 3204, SEQ ID 3205, SEQ ID 3206, SEQ ID 3207, SEQ ID 3208, SEQ ID 3209, SEQ ID 3210, SEQ ID 3211, SEQ ID 3212, SEQ ID 3213, SEQ ID 3214, SEQ ID 3215, SEQ ID 3216, SEQ ID 3217, SEQ ID 3218, SEQ ID 3219, SEQ ID 3220, SEQ ID 3221, SEQ ID 3222, SEQ ID 3223, SEQ ID 3224, SEQ ID 3225, SEQ ID 3226, SEQ ID 3227, SEQ ID 3228, SEQ ID 3229, SEQ ID 3230, SEQ ID 3231, SEQ ID 3232, SEQ ID 3233, SEQ ID 3234, SEQ ID 3235, SEQ ID 3236, SEQ ID 3237, SEQ ID 3238, SEQ ID 3239, SEQ ID 3240, SEQ ID 3241, SEQ ID 3242, SEQ ID 3243, SEQ ID 3244, SEQ ID 3245, SEQ ID 3246, SEQ ID 3248, SEQ ID 3249, SEQ ID 3250, SEQ ID 3251, SEQ ID 3252, SEQ ID 3253, SEQ ID 3254, SEQ ID 3255, SEQ ID 3256, SEQ ID 3257, SEQ ID 3258, SEQ ID 3259, SEQ ID 3260, SEQ ID 3261, SEQ ID 3262, SEQ ID 3263, SEQ ID 3264, SEQ ID 3265, SEQ ID 3266, SEQ ID 3267, SEQ ID 3268, SEQ ID 3269, SEQ ID 3270, SEQ ID 3271, SEQ ID 3272, SEQ ID 3273, SEQ ID 3275, SEQ ID 3276, SEQ ID 3277, SEQ ID 3278, SEQ ID 3279, SEQ ID 3280, SEQ ID 3282, SEQ ID 3284, SEQ ID 3285, SEQ ID 3286, SEQ ID 3287, SEQ ID 3288, SEQ ID 3289, SEQ ID 3291, SEQ ID 3292, SEQ ID 3293, SEQ ID 3294, SEQ ID 3295, SEQ ID 3296, SEQ ID 3297, SEQ ID 3298, SEQ ID 3299, SEQ ID 3300, SEQ ID 3301, SEQ ID 3302, SEQ ID 3303, SEQ ID 3304, SEQ ID 3305, SEQ ID 3306, SEQ ID 3307, SEQ ID 3308, SEQ ID 3309, SEQ ID 3310, SEQ ID 3311, SEQ ID 3312, SEQ ID 3313, SEQ ID 3314, SEQ ID 3315, SEQ ID 3316, SEQ ID 3317, SEQ ID 3318, SEQ ID 3320, SEQ ID 3321, SEQ ID 3322, SEQ ID 3323, SEQ ID 3324, SEQ ID 3325, SEQ ID 3326, SEQ ID 3327, SEQ ID 3329, SEQ ID 3331, SEQ ID 3332, SEQ ID 3333, SEQ ID 3334, SEQ ID 3335, SEQ ID 3336, SEQ ID 3337, SEQ ID 3338, SEQ ID 3339, SEQ ID 3340, SEQ ID 3342, SEQ ID 3343, SEQ ID 3344, SEQ ID 3345, SEQ ID 3346, SEQ ID 3347, SEQ ID 3348, SEQ ID 3349, SEQ ID 3350, SEQ ID 3351, SEQ ID 3352, SEQ ID 3353, SEQ ID 3354, SEQ ID 3355, SEQ ID 3356, SEQ ID 3357, SEQ ID 3358, SEQ ID 3359, SEQ ID 3360, SEQ ID 3361, SEQ ID 3362, SEQ ID 3363, SEQ ID 3364, SEQ ID 3365, SEQ ID 3366, SEQ ID 3367, SEQ ID 3368, SEQ ID 3369, SEQ ID 3370, SEQ ID 3371, SEQ ID 3390, SEQ ID 3391, SEQ ID 3392, SEQ ID 3393, SEQ ID 3394, SEQ ID 3395, SEQ ID 3396, SEQ ID 3397, SEQ ID 3398, SEQ ID 3399, SEQ ID 3400, SEQ ID 3401, SEQ ID 3402, SEQ ID 3403, SEQ ID 3404, SEQ ID 3405, SEQ ID 3406, SEQ ID 3407, SEQ ID 3408, SEQ ID 3409, SEQ ID 3410, SEQ ID 3411, SEQ ID 3412, SEQ ID 3413, SEQ ID 3414, SEQ ID 3415, SEQ ID 3416, SEQ ID 3417, SEQ ID 3418, SEQ ID 3419, SEQ ID 3420, SEQ ID 3421, SEQ ID 3422, SEQ ID 3423, SEQ ID 3424, SEQ ID 3425, SEQ ID 3426, SEQ ID 3427, SEQ ID 3428, SEQ ID 3429, SEQ ID 3430, SEQ ID 3431, SEQ ID 3432, SEQ ID 3433, SEQ ID 3434, SEQ ID 3435, SEQ ID 3436, SEQ ID 3437, SEQ ID 3438, SEQ ID 3439, SEQ ID 3440, SEQ ID 3441, SEQ ID 3442, SEQ ID 3443, SEQ ID 3444, SEQ ID 3445, SEQ ID 3446, SEQ ID 3447, SEQ ID 3448, SEQ ID 3449, SEQ ID 3450, SEQ ID 3451, SEQ ID 3452, SEQ ID 3453, SEQ ID 3454, SEQ ID 3460, SEQ ID 3461, SEQ ID 3464, SEQ ID 3465, SEQ ID 3466, SEQ ID 3467, SEQ ID 3468, SEQ ID 3486, SEQ ID 3487, SEQ ID 3488, SEQ ID 3489, SEQ ID 3490, SEQ ID 3491, SEQ ID 3493, SEQ ID 3494, SEQ ID 3496, SEQ ID 3497, SEQ ID 3501, SEQ ID 3505, SEQ ID 3508, SEQ ID 3511, SEQ ID 3512, SEQ ID 3516, SEQ ID 3517, SEQ ID 3518, SEQ ID 3521, SEQ ID 3522, SEQ ID 3523, SEQ ID 3524, SEQ ID 3525, SEQ ID 3526, SEQ ID 3527, SEQ ID 3528, SEQ ID 3530, SEQ ID 3531, SEQ ID 3532, SEQ ID 3534, SEQ ID 3535, SEQ ID 3536, SEQ ID 3538, SEQ ID 3539, SEQ ID 3541, SEQ ID 3542, SEQ ID 3543, SEQ ID 3544, SEQ ID 3546, SEQ ID 3548, SEQ ID 3549, SEQ ID 3550, SEQ ID 3552, SEQ ID 3556, SEQ ID 3557, SEQ ID 3558, SEQ ID 3560, SEQ ID 3561, SEQ ID 3566, SEQ ID 3567, SEQ ID 3568, SEQ ID 3569, SEQ ID 3571, SEQ ID 3572, SEQ ID 3573, SEQ ID 3574, SEQ ID 3576, SEQ ID 3577, SEQ ID 3578, SEQ ID 3580, SEQ ID 3581, SEQ ID 3584, SEQ ID 3585, SEQ ID 3586, SEQ ID 3588, SEQ ID 3590, SEQ ID 3592, SEQ ID 3594, SEQ ID 3595, SEQ ID 3598, SEQ ID 3599, SEQ ID 3600, SEQ ID 3601, SEQ ID 3602, SEQ ID 3603, SEQ ID 3605, SEQ ID 3607, SEQ ID 3609, SEQ ID 3610, SEQ ID 3613, SEQ ID 3614, SEQ ID 3615, SEQ ID 3616, SEQ ID 3617, SEQ ID 3621, SEQ ID 3623, SEQ ID 3624, SEQ ID 3625, SEQ ID 3626, SEQ ID 3627, SEQ ID 3628, SEQ ID 3629, SEQ ID 3630, SEQ ID 3631, SEQ ID 3632, SEQ ID 3633, SEQ ID 3636, SEQ ID 3637, SEQ ID 3638, SEQ ID 3639, SEQ ID 3641, SEQ ID 3642, SEQ ID 3643, SEQ ID 3645, SEQ ID 3647, SEQ ID 3648, SEQ ID 3649, SEQ ID 3651, SEQ ID 3654, SEQ ID 3656, SEQ ID 3659, SEQ ID 3660, SEQ ID 3661, SEQ ID 3663, SEQ ID 3664, SEQ ID 3665, SEQ ID 3666, SEQ ID 3670, SEQ ID 3672, SEQ ID 3676, SEQ ID 3678, SEQ ID 3679, SEQ ID 3680, SEQ ID 3681, SEQ ID 3682, SEQ ID 3683, SEQ ID 3684, SEQ ID 3685, SEQ ID 3686, SEQ ID 3687, SEQ ID 3688, SEQ ID 3689, SEQ ID 3690, SEQ ID 3691, SEQ ID 3692, SEQ ID 3693, SEQ ID 3694, SEQ ID 3695, SEQ ID 3696, SEQ ID 3697, SEQ ID 3698, SEQ ID 3699, SEQ ID 3700, SEQ ID 3701, SEQ ID 3702, SEQ ID 3703, SEQ ID 3704, SEQ ID 3705, SEQ ID 3706, SEQ ID 3707, SEQ ID 3708, SEQ ID 3709, SEQ ID 3710, SEQ ID 3711, SEQ ID 3712, SEQ ID 3713, SEQ ID 3714, SEQ ID 3715, SEQ ID 3716, SEQ ID 3717, SEQ ID 3718, SEQ ID 3719, SEQ ID 3720, SEQ ID 3721, SEQ ID 3722, SEQ ID 3723, SEQ ID 3724, SEQ ID 3725, SEQ ID 3726, SEQ ID 3727, SEQ ID 3729, SEQ ID 3730, SEQ ID 3731, SEQ ID 3732, SEQ ID 3733, SEQ ID 3734, SEQ ID 3735, SEQ ID 3736, SEQ ID 3737, SEQ ID 3738, SEQ ID 3739, SEQ ID 3740, SEQ ID 3741, SEQ ID 3742, SEQ ID 3743, SEQ ID 3744, SEQ ID 3745, SEQ ID 3746, SEQ ID 3747, SEQ ID 3748, SEQ ID 3749, SEQ ID 3750, SEQ ID 3751, SEQ ID 3752, SEQ ID 3753, SEQ ID 3754, SEQ ID 3755, SEQ ID 3774, SEQ ID 3775, SEQ ID 3776, SEQ ID 3777, SEQ ID 3778, SEQ ID 3779, SEQ ID 3780, SEQ ID 3781, SEQ ID 3782, SEQ ID 3783, SEQ ID 3784, SEQ ID 3785, SEQ ID 3786, SEQ ID 3787, SEQ ID 3788, SEQ ID 3789, SEQ ID 3790, SEQ ID 3791, SEQ ID 3792, SEQ ID 3793, SEQ ID 3794, SEQ ID 3795, SEQ ID 3796, SEQ ID 3797, SEQ ID 3798, SEQ ID 3799, SEQ ID 3800, SEQ ID 3801, SEQ ID 3802, SEQ ID 3803, SEQ ID 3804, SEQ ID 3805, SEQ ID 3806, SEQ ID 3807, SEQ ID 3808, SEQ ID 3809, SEQ ID 3810, SEQ ID 3811, SEQ ID 3812, SEQ ID 3813, SEQ ID 3814, SEQ ID 3815, SEQ ID 3816, SEQ ID 3817, SEQ ID 3818, SEQ ID 3819, SEQ ID 3820, SEQ ID 3821, SEQ ID 3822, SEQ ID 3823, SEQ ID 3824, SEQ ID 3825, SEQ ID 3826, SEQ ID 3827, SEQ ID 3828, SEQ ID 3829, SEQ ID 3830, SEQ ID 3831, SEQ ID 3832, SEQ ID 3833, SEQ ID 3834, SEQ ID 3835, SEQ ID 3836, SEQ ID 3837, SEQ ID 3838, SEQ ID 3839, SEQ ID 3840, SEQ ID 3841, SEQ ID 3842, SEQ ID 3844, SEQ ID 3848, SEQ ID 3850, SEQ ID 3851, SEQ ID 3852, SEQ ID 3853, SEQ ID 3867, SEQ ID 3868, SEQ ID 3869, SEQ ID 3870, SEQ ID 3871, SEQ ID 3872, SEQ ID 3873, SEQ ID 3874, SEQ ID 3875, SEQ ID 3876, SEQ ID 3877, SEQ ID 3878, SEQ ID 3879, SEQ ID 3880, SEQ ID 3881, SEQ ID 3882, SEQ ID 3883, SEQ ID 3884, SEQ ID 3885, SEQ ID 3886, SEQ ID 3887, SEQ ID 3888, SEQ ID 3889, SEQ ID 3890, SEQ ID 3891, SEQ ID 3892, SEQ ID 3893, SEQ ID 3894, SEQ ID 3895, SEQ ID 3896, SEQ ID 3897, SEQ ID 3898, SEQ ID 3899, SEQ ID 3900, SEQ ID 3901, SEQ ID 3902, SEQ ID 3903, SEQ ID 3904, SEQ ID 3905, SEQ ID 3906, SEQ ID 3907, SEQ ID 3908, SEQ ID 3909, SEQ ID 3910, SEQ ID 3911, SEQ ID 3912, SEQ ID 3913, SEQ ID 3914, SEQ ID 3915, SEQ ID 3916, SEQ ID 3917, SEQ ID 3918, SEQ ID 3919, SEQ ID 3920, SEQ ID 3921, SEQ ID 3922, SEQ ID 3923, SEQ ID 3924, SEQ ID 3925, SEQ ID 3926, SEQ ID 3927, SEQ ID 3928, SEQ ID 3929, SEQ ID 3930, SEQ ID 3931, SEQ ID 3932, SEQ ID 3933, SEQ ID 3934, SEQ ID 3935, SEQ ID 3936, SEQ ID 3937, SEQ ID 3938, SEQ ID 3939, SEQ ID 3940, SEQ ID 3941, SEQ ID 3942, SEQ ID 3943, SEQ ID 3944, SEQ ID 3945, SEQ ID 3946, SEQ ID 3947, and SEQ ID 3948.

In some embodiments the target sequence is selected from the group consisting of SEQ ID 2321, SEQ ID 2335, SEQ ID 2336, SEQ ID 2337, SEQ ID 2338, SEQ ID 2339, SEQ ID 2348, SEQ ID 2349, SEQ ID 2351, SEQ ID 2352, SEQ ID 2353, SEQ ID 2354, SEQ ID 2355, SEQ ID 2358, SEQ ID 2360, SEQ ID 2364, SEQ ID 2365, SEQ ID 2366, SEQ ID 2367, SEQ ID 2369, SEQ ID 2371, SEQ ID 2373, SEQ ID 2375, SEQ ID 2386, SEQ ID 2387, SEQ ID 2388, SEQ ID 2389, SEQ ID 2394, SEQ ID 2403, SEQ ID 2426, SEQ ID 2428, SEQ ID 2429, SEQ ID 2430, SEQ ID 2431, SEQ ID 2432, SEQ ID 2435, SEQ ID 2440, SEQ ID 2441, SEQ ID 2442, SEQ ID 2444, SEQ ID 2446, SEQ ID 2447, SEQ ID 2450, SEQ ID 2451, SEQ ID 2452, SEQ ID 2453, SEQ ID 2454, SEQ ID 2455, SEQ ID 2456, SEQ ID 2458, SEQ ID 2459, SEQ ID 2461, SEQ ID 2463, SEQ ID 2464, SEQ ID 2465, SEQ ID 2466, SEQ ID 2467, SEQ ID 2468, SEQ ID 2469, SEQ ID 2470, SEQ ID 2471, SEQ ID 2472, SEQ ID 2473, SEQ ID 2474, SEQ ID 2475, SEQ ID 2476, SEQ ID 2477, SEQ ID 2478, SEQ ID 2482, SEQ ID 2483, SEQ ID 2484, SEQ ID 2485, SEQ ID 2487, SEQ ID 2489, SEQ ID 2494, SEQ ID 2495, SEQ ID 2496, SEQ ID 2497, SEQ ID 2499, SEQ ID 2501, SEQ ID 2502, SEQ ID 2504, SEQ ID 2506, SEQ ID 2507, SEQ ID 2508, SEQ ID 2509, SEQ ID 2511, SEQ ID 2513, SEQ ID 2515, SEQ ID 2516, SEQ ID 2518, SEQ ID 2519, SEQ ID 2520, SEQ ID 2521, SEQ ID 2523, SEQ ID 2525, SEQ ID 2534, SEQ ID 2537, SEQ ID 2544, SEQ ID 2546, SEQ ID 2554, SEQ ID 2555, SEQ ID 2556, SEQ ID 2560, SEQ ID 2561, SEQ ID 2562, SEQ ID 2595, SEQ ID 2626, SEQ ID 2628, SEQ ID 2629, SEQ ID 2630, SEQ ID 2631, SEQ ID 2633, SEQ ID 2638, SEQ ID 2639, SEQ ID 2640, SEQ ID 2649, SEQ ID 2651, SEQ ID 2652, SEQ ID 2655, SEQ ID 2658, SEQ ID 2665, SEQ ID 2666, SEQ ID 2667, SEQ ID 2669, SEQ ID 2670, SEQ ID 2676, SEQ ID 2677, SEQ ID 2678, SEQ ID 2679, SEQ ID 2682, SEQ ID 2686, SEQ ID 2688, SEQ ID 2689, SEQ ID 2691, SEQ ID 2694, SEQ ID 2698, SEQ ID 2699, SEQ ID 2700, SEQ ID 2701, SEQ ID 2703, SEQ ID 2706, SEQ ID 2709, SEQ ID 2711, SEQ ID 2712, SEQ ID 2713, SEQ ID 2714, SEQ ID 2719, SEQ ID 2720, SEQ ID 2721, SEQ ID 2737, SEQ ID 2739, SEQ ID 2740, SEQ ID 2741, SEQ ID 2742, SEQ ID 2743, SEQ ID 2744, SEQ ID 2745, SEQ ID 2746, SEQ ID 2747, SEQ ID 2748, SEQ ID 2749, SEQ ID 2750, SEQ ID 2751, SEQ ID 2752, SEQ ID 2753, SEQ ID 2754, SEQ ID 2755, SEQ ID 2756, SEQ ID 2757, SEQ ID 2758, SEQ ID 2760, SEQ ID 2763, SEQ ID 2764, SEQ ID 2765, SEQ ID 2766, SEQ ID 2767, SEQ ID 2768, SEQ ID 2769, SEQ ID 2770, SEQ ID 2771, SEQ ID 2772, SEQ ID 2774, SEQ ID 2816, SEQ ID 2817, SEQ ID 2818, SEQ ID 2819, SEQ ID 2820, SEQ ID 2824, SEQ ID 2828, SEQ ID 2829, SEQ ID 2830, SEQ ID 2831, SEQ ID 2832, SEQ ID 2833, SEQ ID 2834, SEQ ID 2835, SEQ ID 2836, SEQ ID 2837, SEQ ID 2851, SEQ ID 2852, SEQ ID 2866, SEQ ID 2871, SEQ ID 2872, SEQ ID 2886, SEQ ID 2887, SEQ ID 2890, SEQ ID 2891, SEQ ID 2892, SEQ ID 2895, SEQ ID 2896, SEQ ID 2899, SEQ ID 2904, SEQ ID 2910, SEQ ID 2911, SEQ ID 2912, SEQ ID 2913, SEQ ID 2914, SEQ ID 2916, SEQ ID 2918, SEQ ID 2919, SEQ ID 2920, SEQ ID 2922, SEQ ID 2925, SEQ ID 2926, SEQ ID 2932, SEQ ID 2939, SEQ ID 2941, SEQ ID 2942, SEQ ID 2943, SEQ ID 2972, SEQ ID 2973, SEQ ID 2974, SEQ ID 2975, SEQ ID 2976, SEQ ID 2977, SEQ ID 2980, SEQ ID 2983, SEQ ID 2985, SEQ ID 3053, SEQ ID 3054, SEQ ID 3055, SEQ ID 3056, SEQ ID 3058, SEQ ID 3059, SEQ ID 3060, SEQ ID 3061, SEQ ID 3062, SEQ ID 3063, SEQ ID 3064, SEQ ID 3065, SEQ ID 3066, SEQ ID 3068, SEQ ID 3069, SEQ ID 3070, SEQ ID 3071, SEQ ID 3072, SEQ ID 3073, SEQ ID 3074, SEQ ID 3075, SEQ ID 3076, SEQ ID 3077, SEQ ID 3078, SEQ ID 3079, SEQ ID 3082, SEQ ID 3083, SEQ ID 3084, SEQ ID 3085, SEQ ID 3088, SEQ ID 3089, SEQ ID 3090, SEQ ID 3091, SEQ ID 3092, SEQ ID 3095, SEQ ID 3097, SEQ ID 3102, SEQ ID 3106, SEQ ID 3108, SEQ ID 3110, SEQ ID 3116, SEQ ID 3120, SEQ ID 3121, SEQ ID 3125, SEQ ID 3126, SEQ ID 3133, SEQ ID 3134, SEQ ID 3135, SEQ ID 3137, SEQ ID 3138, SEQ ID 3140, SEQ ID 3141, SEQ ID 3142, SEQ ID 3143, SEQ ID 3145, SEQ ID 3148, SEQ ID 3152, SEQ ID 3153, SEQ ID 3156, SEQ ID 3157, SEQ ID 3158, SEQ ID 3159, SEQ ID 3160, SEQ ID 3161, SEQ ID 3162, SEQ ID 3163, SEQ ID 3164, SEQ ID 3165, SEQ ID 3166, SEQ ID 3167, SEQ ID 3168, SEQ ID 3169, SEQ ID 3170, SEQ ID 3172, SEQ ID 3173, SEQ ID 3174, SEQ ID 3175, SEQ ID 3176, SEQ ID 3177, SEQ ID 3178, SEQ ID 3179, SEQ ID 3180, SEQ ID 3181, SEQ ID 3182, SEQ ID 3183, SEQ ID 3184, SEQ ID 3186, SEQ ID 3188, SEQ ID 3191, SEQ ID 3193, SEQ ID 3196, SEQ ID 3197, SEQ ID 3203, SEQ ID 3205, SEQ ID 3206, SEQ ID 3207, SEQ ID 3210, SEQ ID 3211, SEQ ID 3212, SEQ ID 3213, SEQ ID 3214, SEQ ID 3215, SEQ ID 3216, SEQ ID 3217, SEQ ID 3218, SEQ ID 3219, SEQ ID 3221, SEQ ID 3222, SEQ ID 3223, SEQ ID 3224, SEQ ID 3227, SEQ ID 3236, SEQ ID 3237, SEQ ID 3238, SEQ ID 3239, SEQ ID 3240, SEQ ID 3241, SEQ ID 3242, SEQ ID 3243, SEQ ID 3244, SEQ ID 3245, SEQ ID 3246, SEQ ID 3248, SEQ ID 3249, SEQ ID 3250, SEQ ID 3251, SEQ ID 3252, SEQ ID 3254, SEQ ID 3258, SEQ ID 3259, SEQ ID 3261, SEQ ID 3263, SEQ ID 3265, SEQ ID 3266, SEQ ID 3267, SEQ ID 3271, SEQ ID 3272, SEQ ID 3273, SEQ ID 3276, SEQ ID 3277, SEQ ID 3279, SEQ ID 3286, SEQ ID 3295, SEQ ID 3297, SEQ ID 3305, SEQ ID 3307, SEQ ID 3309, SEQ ID 3312, SEQ ID 3313, SEQ ID 3314, SEQ ID 3316, SEQ ID 3317, SEQ ID 3318, SEQ ID 3320, SEQ ID 3332, SEQ ID 3335, SEQ ID 3336, SEQ ID 3337, SEQ ID 3338, SEQ ID 3339, SEQ ID 3340, SEQ ID 3342, SEQ ID 3343, SEQ ID 3345, SEQ ID 3346, SEQ ID 3347, SEQ ID 3348, SEQ ID 3349, SEQ ID 3350, SEQ ID 3351, SEQ ID 3352, SEQ ID 3353, SEQ ID 3354, SEQ ID 3355, SEQ ID 3356, SEQ ID 3359, SEQ ID 3360, SEQ ID 3361, SEQ ID 3362, SEQ ID 3363, SEQ ID 3364, SEQ ID 3365, SEQ ID 3366, SEQ ID 3369, SEQ ID 3370, SEQ ID 3390, SEQ ID 3392, SEQ ID 3393, SEQ ID 3394, SEQ ID 3395, SEQ ID 3396, SEQ ID 3397, SEQ ID 3398, SEQ ID 3399, SEQ ID 3401, SEQ ID 3403, SEQ ID 3404, SEQ ID 3407, SEQ ID 3408, SEQ ID 3409, SEQ ID 3410, SEQ ID 3411, SEQ ID 3412, SEQ ID 3413, SEQ ID 3414, SEQ ID 3415, SEQ ID 3417, SEQ ID 3419, SEQ ID 3420, SEQ ID 3422, SEQ ID 3423, SEQ ID 3424, SEQ ID 3428, SEQ ID 3429, SEQ ID 3430, SEQ ID 3432, SEQ ID 3433, SEQ ID 3434, SEQ ID 3435, SEQ ID 3436, SEQ ID 3437, SEQ ID 3439, SEQ ID 3440, SEQ ID 3441, SEQ ID 3442, SEQ ID 3443, SEQ ID 3444, SEQ ID 3445, SEQ ID 3446, SEQ ID 3447, SEQ ID 3448, SEQ ID 3449, SEQ ID 3450, SEQ ID 3451, SEQ ID 3452, SEQ ID 3460, SEQ ID 3461, SEQ ID 3466, SEQ ID 3467, SEQ ID 3468, SEQ ID 3490, SEQ ID 3494, SEQ ID 3496, SEQ ID 3501, SEQ ID 3505, SEQ ID 3511, SEQ ID 3512, SEQ ID 3516, SEQ ID 3517, SEQ ID 3521, SEQ ID 3522, SEQ ID 3556, SEQ ID 3557, SEQ ID 3561, SEQ ID 3566, SEQ ID 3567, SEQ ID 3568, SEQ ID 3569, SEQ ID 3571, SEQ ID 3572, SEQ ID 3576, SEQ ID 3578, SEQ ID 3580, SEQ ID 3584, SEQ ID 3594, SEQ ID 3613, SEQ ID 3614, SEQ ID 3624, SEQ ID 3625, SEQ ID 3626, SEQ ID 3627, SEQ ID 3628, SEQ ID 3633, SEQ ID 3641, SEQ ID 3643, SEQ ID 3648, SEQ ID 3651, SEQ ID 3654, SEQ ID 3656, SEQ ID 3659, SEQ ID 3660, SEQ ID 3661, SEQ ID 3670, SEQ ID 3676, SEQ ID 3680, SEQ ID 3681, SEQ ID 3683, SEQ ID 3684, SEQ ID 3685, SEQ ID 3686, SEQ ID 3687, SEQ ID 3688, SEQ ID 3689, SEQ ID 3691, SEQ ID 3693, SEQ ID 3694, SEQ ID 3695, SEQ ID 3696, SEQ ID 3698, SEQ ID 3700, SEQ ID 3701, SEQ ID 3703, SEQ ID 3704, SEQ ID 3707, SEQ ID 3708, SEQ ID 3709, SEQ ID 3710, SEQ ID 3711, SEQ ID 3712, SEQ ID 3713, SEQ ID 3714, SEQ ID 3715, SEQ ID 3716, SEQ ID 3717, SEQ ID 3718, SEQ ID 3719, SEQ ID 3720, SEQ ID 3721, SEQ ID 3722, SEQ ID 3723, SEQ ID 3725, SEQ ID 3744, SEQ ID 3747, SEQ ID 3748, SEQ ID 3749, SEQ ID 3750, SEQ ID 3751, SEQ ID 3752, SEQ ID 3753, SEQ ID 3754, SEQ ID 3755, SEQ ID 3774, SEQ ID 3775, SEQ ID 3776, SEQ ID 3786, SEQ ID 3788, SEQ ID 3790, SEQ ID 3791, SEQ ID 3793, SEQ ID 3794, SEQ ID 3795, SEQ ID 3796, SEQ ID 3797, SEQ ID 3798, SEQ ID 3799, SEQ ID 3800, SEQ ID 3801, SEQ ID 3802, SEQ ID 3803, SEQ ID 3804, SEQ ID 3805, SEQ ID 3809, SEQ ID 3810, SEQ ID 3811, SEQ ID 3812, SEQ ID 3813, SEQ ID 3814, SEQ ID 3815, SEQ ID 3821, SEQ ID 3822, SEQ ID 3823, SEQ ID 3824, SEQ ID 3825, SEQ ID 3826, SEQ ID 3827, SEQ ID 3828, SEQ ID 3830, SEQ ID 3831, SEQ ID 3832, SEQ ID 3834, SEQ ID 3836, SEQ ID 3837, SEQ ID 3838, SEQ ID 3839, SEQ ID 3840, SEQ ID 3841, SEQ ID 3842, SEQ ID 3844, SEQ ID 3850, SEQ ID 3852, SEQ ID 3867, SEQ ID 3868, SEQ ID 3870, SEQ ID 3871, SEQ ID 3872, SEQ ID 3873, SEQ ID 3874, SEQ ID 3875, SEQ ID 3876, SEQ ID 3879, SEQ ID 3880, SEQ ID 3881, SEQ ID 3882, SEQ ID 3883, SEQ ID 3884, SEQ ID 3885, SEQ ID 3886, SEQ ID 3887, SEQ ID 3888, SEQ ID 3889, SEQ ID 3890, SEQ ID 3891, SEQ ID 3892, SEQ ID 3893, SEQ ID 3894, SEQ ID 3895, SEQ ID 3896, SEQ ID 3897, SEQ ID 3908, SEQ ID 3909, SEQ ID 3910, SEQ ID 3911, SEQ ID 3912, SEQ ID 3913, SEQ ID 3922, SEQ ID 3923, SEQ ID 3930, SEQ ID 3935, SEQ ID 3936, SEQ ID 3937, SEQ ID 3938, SEQ ID 3939, SEQ ID 3940, SEQ ID 3944, SEQ ID 3945, SEQ ID 3946, SEQ ID 3947, and SEQ ID 3948.

In some embodiments the oligonucleotide comprises the contiguous nucleotide sequence, and may optionally comprise further nucleotide(s), for example a nucleotide linker region which may be used to attach a functional group (e.g. a conjugate group) to the contiguous nucleotide sequence. The nucleotide linker region may or may not be complementary to the target nucleic acid. It is understood that the contiguous nucleotide sequence of the oligonucleotide cannot be longer than the oligonucleotide as such and that the oligonucleotide cannot be shorter than the contiguous nucleotide sequence.

Nucleotides and Nucleosides

Nucleotides and nucleosides are the building blocks of oligonucleotides and polynucleotides, and for the purposes of the present invention include both naturally occurring and non-naturally occurring nucleotides and nucleosides. In nature, nucleotides, such as DNA and RNA nucleotides comprise a ribose sugar moiety, a nucleobase moiety and one or more phosphate groups (which is absent in nucleosides). Nucleosides and nucleotides may also interchangeably be referred to as "units" or "monomers".

Modified Nucleoside

Advantageously, the antisense oligonucleotide progranulin agonist of the invention may comprise one or more modified nucleoside.

The term "modified nucleoside" or "nucleoside modification" as used herein refers to nucleosides modified as compared to the equivalent DNA or RNA nucleoside by the introduction of one or more modifications of the sugar moiety or the (nucleo) base moiety. Advantageously, one or more of the modified nucleosides of the antisense oligonucleotides of the invention may comprise a modified sugar moiety. The term modified nucleoside may also be used herein interchangeably with the term "nucleoside analogue" or modified "units" or modified "monomers". Nucleosides with an unmodified DNA or RNA sugar moiety are termed DNA or RNA nucleosides herein. Nucleosides with modifications in the base region of the DNA or RNA nucleoside are still generally termed DNA or RNA if they allow Watson Crick base pairing. Exemplary modified nucleosides which may be used in the antisense oligonucleotide progranulin agonists of the invention include LNA, 2'-O-MOE, 2'oMe and morpholino nucleoside analogues.

Modified Internucleoside Linkage

Advantageously, the antisense oligonucleotide progranulin agonist of the invention comprises one or more modified internucleoside linkage.

The term "modified internucleoside linkage" is defined as generally understood by the skilled person as linkages other than phosphodiester (PO) linkages, that covalently couple two nucleosides together. The antisense oligonucleotide progranulin agonists of the invention may therefore comprise one or more modified internucleoside linkages such as one or more phosphorothioate internucleoside linkage.

In some embodiments at least 50% of the internucleoside linkages in the antisense oligonucleotide progranulin agonist, or contiguous nucleotide sequence thereof, are phosphorothioate, such as at least 60%, such as at least 70%, such as at least 75%, such as at least 80%, such as at least 90% or more of the internucleoside linkages in the antisense oligonucleotide progranulin agonist, or contiguous nucleotide sequence thereof, are phosphorothioate. In some embodiments all of the internucleoside linkages of the antisense oligonucleotide progranulin agonist, or contiguous nucleotide sequence thereof, are phosphorothioate.

Advantageously, all the internucleoside linkages of the contiguous nucleotide sequence of the antisense oligonucleotide progranulin agonist may be phosphorothioate, or all the internucleoside linkages of the antisense oligonucleotide progranulin agonist may be phosphorothioate linkages.

Nucleobase

The term nucleobase includes the purine (e.g. adenine and guanine) and pyrimidine (e.g. uracil, thymine and cytosine) moiety present in nucleosides and nucleotides which form hydrogen bonds in nucleic acid hybridization. In the context of the present invention the term nucleobase also encompasses modified nucleobases which may differ from naturally occurring nucleobases, but which are functional during nucleic acid hybridization. In this context "nucleobase" refers to both naturally occurring nucleobases such as adenine, guanine, cytosine, thymidine, uracil, xanthine and hypoxanthine, as well as non-naturally occurring variants. Such variants are for example described in Hirao et al (2012) Accounts of Chemical Research vol 45 page 2055 and Bergstrom (2009) Current Protocols in Nucleic Acid Chemistry Suppl. 37 1.4.1.

In some embodiments the nucleobase moiety is modified by changing the purine or pyrimidine into a modified purine or pyrimidine, such as substituted purine or substituted pyrimidine, such as a nucleobase selected from isocytosine, pseudoisocytosine, 5-methyl cytosine, 5-thiozolo-cytosine, 5-propynyl-cytosine, 5-propynyl-uracil, 5-bromouracil 5-thiazolo-uracil, 2-thio-uracil, 2'thio-thymine, inosine, diaminopurine, 6-aminopurine, 2-aminopurine, 2,6-diaminopurine and 2-chloro-6-aminopurine.

The nucleobase moieties may be indicated by the letter code for each corresponding nucleobase, e.g. A, T, G, C or U, wherein each letter may optionally include modified nucleobases of equivalent function. For example, in the exemplified oligonucleotides, the nucleobase moieties are selected from A, T, G, C, and 5-methyl cytosine. Optionally, for LNA gapmers, 5-methyl cytosine LNA nucleosides may be used.

Modified Oligonucleotide

The antisense oligonucleotide progranulin agonist of the invention may be a modified oligonucleotide.

The term modified oligonucleotide describes an oligonucleotide comprising one or more sugar-modified nucleosides and/or modified internucleoside linkages. The term "chimeric oligonucleotide" is a term that has been used in the literature to describe oligonucleotides comprising sugar modified nucleosides and DNA nucleosides. In some embodiments, it may be advantageous for the antisense oligonucleotide progranulin agonist of the invention to be a chimeric oligonucleotide.

Complementarity

The term "complementarity" describes the capacity for Watson-Crick base-pairing of nucleosides/nucleotides. Watson-Crick base pairs are guanine (G)-cytosine (C) and adenine (A)-thymine (T)/uracil (U).

It will be understood that oligonucleotides may comprise nucleosides with modified nucleobases, for example 5-methyl cytosine is often used in place of cytosine, and as such the term complementarity encompasses Watson Crick base-paring between non-modified and modified nucleobases (see for example Hirao et al (2012) Accounts of Chemical Research vol 45 page 2055 and Bergstrom (2009) Current Protocols in Nucleic Acid Chemistry Suppl. 37 1.4.1).

The term "% complementary" as used herein, refers to the proportion of nucleotides (in percent) of a contiguous nucleotide sequence in a nucleic acid molecule (e.g. oligonucleotide) which across the contiguous nucleotide sequence, are complementary to a reference sequence (e.g. a target sequence or sequence motif). The percentage of complementarity is thus calculated by counting the number of aligned nucleobases that are complementary (from Watson Crick base pairs) between the two sequences (when aligned with the target sequence 5'-3' and the oligonucleotide sequence from 3'-5'), dividing that number by the total number of nucleotides in the oligonucleotide and multiplying by 100. In such a comparison a nucleobase/nucleotide which does not align (form a base pair) is termed a mismatch. Insertions and deletions are not allowed in the calculation of % complementarity of a contiguous nucleotide sequence. It will be understood that in determining complementarity, chemical modifications of the nucleobases are disregarded as long as the functional capacity of the nucleobase to form Watson Crick base pairing is retained (e.g. 5'-methyl cytosine is considered identical to a cytosine for the purpose of calculating % identity).

Within the present invention the term "complementary" requires the antisense oligonucleotide progranulin agonist to be at least about 80% complementary, or at least about 90% complementary, to a human progranulin precursor-mRNA (pre-mRNA) or mature mRNA transcript. In some embodiments the antisense oligonucleotide progranulin agonist may be at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98% or at least about 99% complementary to a human progranulin precursor-mRNA (pre-mRNA) or mature mRNA transcript. Put another way, for some embodiments, an antisense oligonucleotide progranulin agonist of the invention may include one, two, three or more mis-matches, wherein a mis-match is a nucleotide within the antisense oligonucleotide progranulin agonist of the invention which does not base pair with its target.

The term "fully complementary", refers to 100% complementarity.

The antisense oligonucleotide progranulin agonists of the invention are advantageously complementary to the human progranulin precursor mRNA (pre-mRNA) or the human progranulin mature mRNA sequence. The human progranulin mature mRNA sequence is exemplified herein as SEQ ID NO 1. The human progranulin precursor-mRNA (pre-mRNA) sequence is exemplified herein as SEQ ID NO 3949. SEQ ID NO 1 and SEQ ID NO 3949 are provided herein as reference sequences and it will be understood that the target progranulin nucleic acid may be an allelic variant of SEQ ID NO 1 or SEQ ID NO 3949, such as an allelic variant which comprises one or more polymorphism in the human progranulin nucleic acid sequence.

Identity

The term "identity" as used herein, refers to the proportion of nucleotides (expressed in percent) of a contiguous nucleotide sequence in a nucleic acid molecule (e.g. oligonucleotide) which across the contiguous nucleotide sequence, are identical to a reference sequence (e.g. a sequence motif).

The percentage of identity is thus calculated by counting the number of aligned nucleobases that are identical (a Match) between two sequences (in the contiguous nucleotide sequence of the compound of the invention and in the reference sequence), dividing that number by the total number of nucleotides in the oligonucleotide and multiplying by 100. Therefore, Percentage of Identity=(Matches× 100)/Length of aligned region (e.g. the contiguous nucleotide sequence). Insertions and deletions are not allowed in the calculation the percentage of identity of a contiguous nucleotide sequence. It will be understood that in determining identity, chemical modifications of the nucleobases are disregarded as long as the functional capacity of the nucleobase to form Watson Crick base pairing is retained (e.g. 5-methyl cytosine is considered identical to a cytosine for the purpose of calculating % identity).

Hybridization

The terms "hybridizing" or "hybridizes" as used herein are to be understood as two nucleic acid strands (e.g. an oligonucleotide and a target nucleic acid) forming hydrogen bonds between base pairs on opposite strands thereby forming a duplex. The affinity of the binding between two nucleic acid strands is the strength of the hybridization. It is often described in terms of the melting temperature ($T_m$) defined as the temperature at which half of the oligonucleotides are duplexed with the target nucleic acid. At physiological conditions $T_m$ is not strictly proportional to the affinity (Mergny and Lacroix, 2003, *Oligonucleotides* 13:515-537). The standard state Gibbs free energy $\Delta G°$ is a more accurate representation of binding affinity and is related to the dissociation constant ($K_d$) of the reaction by $\Delta G°=-RTln(K_d)$, where R is the gas constant and T is the absolute temperature. Therefore, a very low $\Delta G°$ of the reaction between an oligonucleotide and the target nucleic acid reflects a strong hybridization between the oligonucleotide and target nucleic acid. $\Delta G°$ is the energy associated with a reaction where aqueous concentrations are 1M, the pH is 7, and the temperature is 37° C. The hybridization of oligonucleotides to a target nucleic acid is a spontaneous reaction and for spontaneous reactions $\Delta G°$ is less than zero. $\Delta G°$ can be measured experimentally, for example, by use of the isothermal titration calorimetry (ITC) method as described in Hansen et al., 1965, *Chem. Comm.* 36-38 and Holdgate et al., 2005, *Drug Discov Today*. The skilled person will know that commercial equipment is available for $\Delta G°$ measurements. $\Delta G°$ can also be estimated numerically by using the nearest neighbor model as described by SantaLucia, 1998, *Proc Natl Acad Sci USA.* 95:1460-1465 using appropriately derived thermodynamic parameters described by Sugimoto et al., 1995, *Biochemistry* 34:11211-11216 and McTigue et al., 2004, *Biochemistry* 43:5388-5405.

In some embodiments, antisense oligonucleotide progranulin agonists of the present invention hybridize to a target nucleic acid with estimated ΔG° values below −10 kcal for oligonucleotides that are 10-30 nucleotides in length.

In some embodiments the degree or strength of hybridization is measured by the standard state Gibbs free energy ΔG°. The oligonucleotides may hybridize to a target nucleic acid with estimated ΔG° values below the range of −10 kcal, such as below −15 kcal, such as below −20 kcal and such as below −25 kcal for oligonucleotides that are 8-30 nucleotides in length. In some embodiments the oligonucleotides hybridize to a target nucleic acid with an estimated ΔG° value of −10 to −60 kcal, such as −12 to −40, such as from −15 to −30 kcal, or −16 to −27 kcal such as −18 to −25 kcal.

High Affinity Modified Nucleosides

A high affinity modified nucleoside is a modified nucleotide which, when incorporated into the oligonucleotide enhances the affinity of the oligonucleotide for its complementary target, for example as measured by the melting temperature (T$_m$). A high affinity modified nucleoside of the present invention preferably results in an increase in melting temperature between +0.5 to +12° C., more preferably between +1.5 to +10° C. and most preferably between +3 to +8° C. per modified nucleoside. Numerous high affinity modified nucleosides are known in the art and include for example, many 2' substituted nucleosides as well as locked nucleic acids (LNA) (see e.g. Freier & Altmann; Nucl. Acid Res., 1997, 25, 4429-4443 and Uhlmann; Curr. Opinion in Drug Development, 2000, 3 (2), 293-213).

Sugar Modifications

The antisense oligonucleotide progranulin agonist of the invention may comprise one or more nucleosides which have a modified sugar moiety, i.e. a modification of the sugar moiety when compared to the ribose sugar moiety found in DNA and RNA.

Numerous nucleosides with modification of the ribose sugar moiety have been made, primarily with the aim of improving certain properties of oligonucleotides, such as affinity and/or nuclease resistance.

Such modifications include those where the ribose ring structure is modified, e.g. by replacement with a hexose ring (HNA), or a bicyclic ring, which typically have a biradicle bridge between the C2 and C4 carbons on the ribose ring (LNA), or an unlinked ribose ring which typically lacks a bond between the C2 and C3 carbons (e.g. UNA). Other sugar modified nucleosides include, for example, bicyclohexose nucleic acids (WO2011/017521) or tricyclic nucleic acids (WO2013/154798). Modified nucleosides also include nucleosides where the sugar moiety is replaced with a non-sugar moiety, for example in the case of peptide nucleic acids (PNA), or morpholino nucleic acids.

Sugar modifications also include modifications made via altering the substituent groups on the ribose ring to groups other than hydrogen, or the 2'-OH group naturally found in DNA and RNA nucleosides. Substituents may, for example be introduced at the 2', 3', 4' or 5' positions.

2' Sugar Modified Nucleosides

A 2' sugar modified nucleoside is a nucleoside which has a substituent other than H or -OH at the 2' position (2' substituted nucleoside) or comprises a 2' linked biradicle capable of forming a bridge between the 2' carbon and a second carbon in the ribose ring, such as LNA (2'-4' biradicle bridged) nucleosides.

Indeed, much focus has been spent on developing 2' sugar substituted nucleosides, and numerous 2' substituted nucleosides have been found to have beneficial properties when incorporated into oligonucleotides. For example, the 2' modified sugar may provide enhanced binding affinity and/or increased nuclease resistance to the oligonucleotide. Examples of 2' substituted modified nucleosides are 2'-O-alkyl-RNA, 2'-O-methyl-RNA (2'oMe), 2'-alkoxy-RNA, 2'-O-methoxyethyl-RNA (MOE), 2'-amino-DNA, 2'-Fluoro-RNA, and 2'-F-ANA nucleoside. For further examples, please see e.g. Freier & Altmann; Nucl. Acid Res., 1997, 25, 4429-4443 and Uhlmann; Curr. Opinion in Drug Development, 2000, 3 (2), 293-213, and Deleavey and Damha, Chemistry and Biology 2012, 19, 937. Below are illustrations of some 2' substituted modified nucleosides.

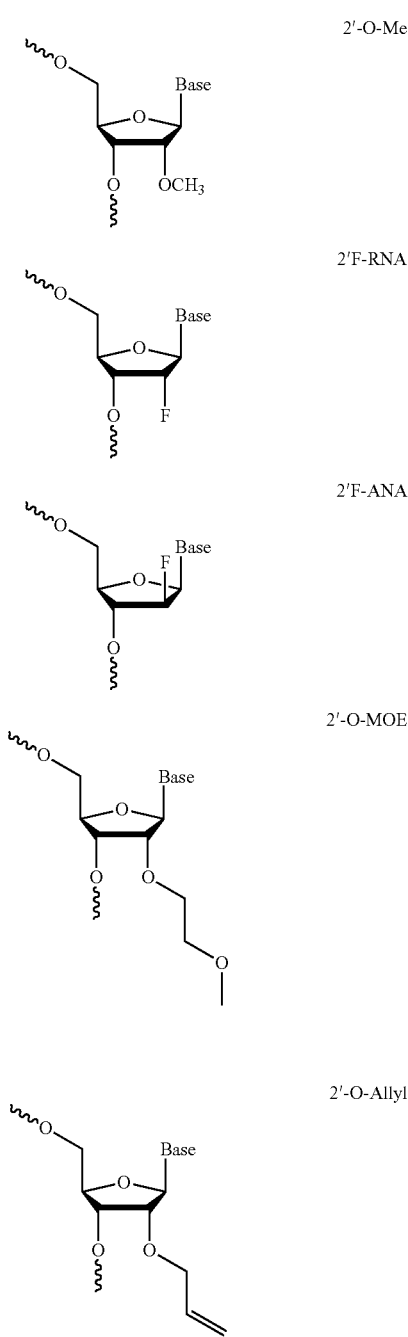

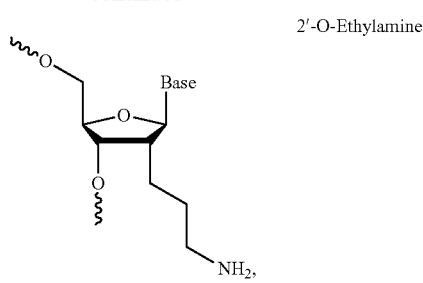

2'-O-Ethylamine

In relation to the present invention 2' substituted sugar modified nucleosides does not include 2' bridged nucleosides like LNA.

Locked Nucleic Acid Nucleosides (LNA Nucleoside)

A "LNA nucleoside" is a 2'-modified nucleoside which comprises a biradical linking the C2' and C4' of the ribose sugar ring of said nucleoside (also referred to as a "2'-4' bridge"), which restricts or locks the conformation of the ribose ring. These nucleosides are also termed bridged nucleic acid or bicyclic nucleic acid (BNA) in the literature. The locking of the conformation of the ribose is associated with an enhanced affinity of hybridization (duplex stabilization) when the LNA is incorporated into an oligonucleotide for a complementary RNA or DNA molecule. This can be routinely determined by measuring the melting temperature of the oligonucleotide/complement duplex.

Non limiting, exemplary LNA nucleosides are disclosed in WO 99/014226, WO 00/66604, WO 98/039352, WO 2004/046160, WO 00/047599, WO 2007/134181, WO 2010/077578, WO 2010/036698, WO 2007/090071, WO 2009/006478, WO 2011/156202, WO 2008/154401, WO 2009/067647, WO 2008/150729, Morita et al., Bioorganic & Med. Chem. Lett. 12, 73-76, Seth et al. J. Org. Chem. 2010, Vol 75 (5) pp. 1569-81, and Mitsuoka et al., Nucleic Acids Research 2009, 37 (4), 1225-1238, and Wan and Seth, J. Medical Chemistry 2016, 59, 9645-9667.

Further non limiting, exemplary LNA nucleosides are disclosed in Scheme 1.

Scheme 1

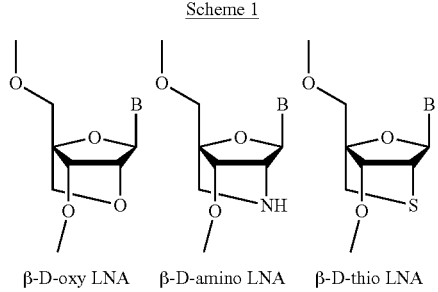

β-D-oxy LNA   β-D-amino LNA   β-D-thio LNA

α-L-oxy LNA   α-L-amino LNA   α-L-thio LNA

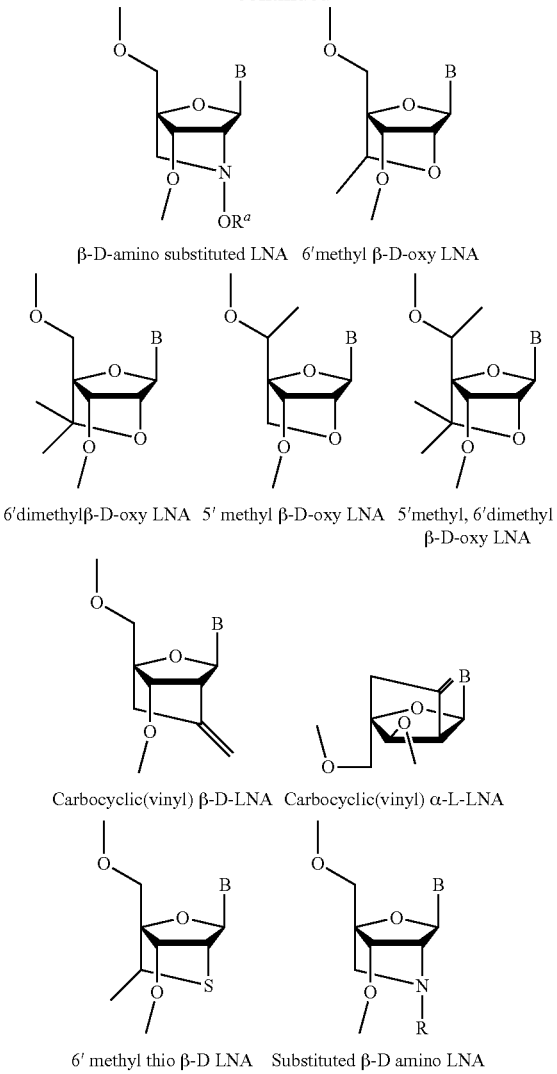

β-D-amino substituted LNA   6'methyl β-D-oxy LNA

6'dimethylβ-D-oxy LNA   5' methyl β-D-oxy LNA   5'methyl, 6'dimethyl β-D-oxy LNA Carbocyclic(vinyl) β-D-LNA   Carbocyclic(vinyl) α-L-LNA 6' methyl thio β-D LNA   Substituted β-D amino LNA Particular LNA nucleosides are beta-D-oxy-LNA, 6'-methyl-beta-D-oxy LNA such as(S)-6'-methyl-beta-D-oxy-LNA (ScET) and ENA.

A particularly advantageous LNA is beta-D-oxy-LNA.

Morpholino Oligonucleotides

In some embodiments, the antisense oligonucleotide progranulin agonist of the invention comprises or consists of morpholino nucleosides (i.e. is a Morpholino oligomer and as a phosphorodiamidate Morpholino oligomer (PMO)). Splice modulating morpholino oligonucleotides have been approved for clinical use—see for example eteplirsen, a 30 nt morpholino oligonucleotide targeting a frame shift mutation in DMD, used to treat Duchenne muscular dystrophy. Morpholino oligonucleotides have nucleobases attached to six membered morpholine rings rather ribose, such as methylenemorpholine rings linked through phosphorodiamidate groups, for example as illustrated by the following illustration of 4 consecutive morpholino nucleotides:

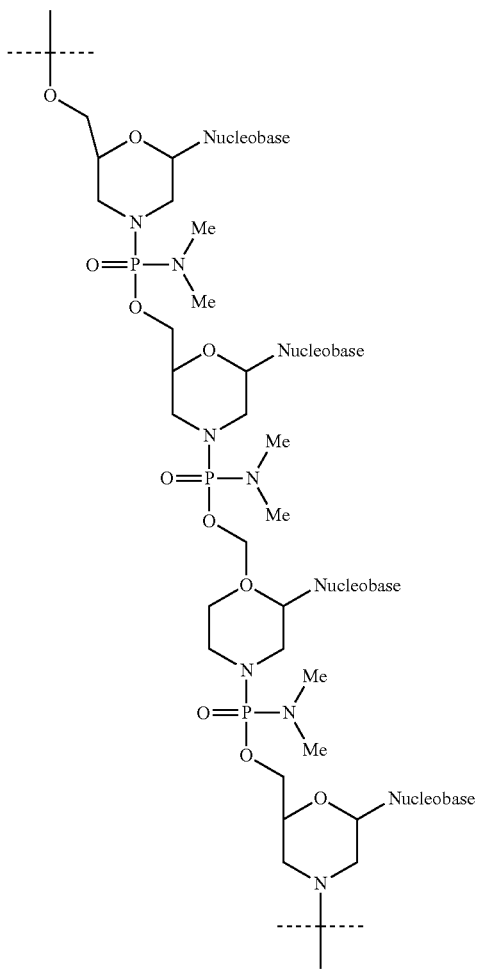

In some embodiments, morpholino oligonucleotides of the invention may be, for example 20-40 morpholino nucleotides in length, such as morpholino 25-35 nucleotides in length.

Rnase H Activity and Recruitment

The RNase H activity of an antisense oligonucleotide refers to its ability to recruit RNase H when in a duplex with a complementary RNA molecule. WO01/23613 provides in vitro methods for determining RNaseH activity, which may be used to determine the ability to recruit RNaseH. Typically an oligonucleotide is deemed capable of recruiting RNase H if it, when provided with a complementary target nucleic acid sequence, has an initial rate, as measured in pmol/l/min, of at least 5%, such as at least 10%, at least 20% or more than 20%, of the initial rate determined when using an oligonucleotide having the same base sequence as the modified oligonucleotide being tested, but containing only DNA monomers with phosphorothioate linkages between all monomers in the oligonucleotide, and using the methodology provided by Examples 91-95 of WO01/23613 (hereby incorporated by reference). For use in determining RHase H activity, recombinant RNase H1 is available from Lubio Science GmbH, Lucerne, Switzerland.

DNA oligonucleotides are known to effectively recruit RNaseH, as are gapmer oligonucleotides which comprise a region of DNA nucleosides (typically at least 5 or 6 contiguous DNA nucleosides), flanked 5' and 3' by regions comprising 2' sugar modified nucleosides, typically high affinity 2' sugar modified nucleosides, such as 2-O-MOE and/or LNA. For effective modulation of splicing, degradation of the pre-mRNA is not desirable, and as such it is preferable to avoid the RNaseH degradation of the target. Therefore, the antisense oligonucleotide progranulin agonists of the invention are not RNaseH recruiting gapmer oligonucleotide.

RNaseH recruitment may be avoided by limiting the number of contiguous DNA nucleotides in the oligonucleotide—therefore mixes and totalmer designs may be used. Advantageously the antisense oligonucleotide progranulin agonist of the invention, or the contiguous nucleotide sequence thereof, do not comprise more than 3 contiguous DNA nucleosides. Further, advantageously the antisense oligonucleotide progranulin agonists of the invention, or the contiguous nucleotide sequence thereof, do not comprise more than 4 contiguous DNA nucleosides. Further advantageously, the progranulin agonist antisense oligonucleotide agonists of the invention, or contiguous nucleotide sequence thereof, do not comprise more than 2 contiguous DNA nucleosides.

Mixmers and Totalmers

For splice modulation it is often advantageous to use antisense oligonucleotides which do not recruit RNAaseH. As RNaseH activity requires a contiguous sequence of DNA nucleotides, RNaseH activity of antisense oligonucleotide may be achieved by designing antisense oligonucleotides which do not comprise a region of more than 3 or more than 4 contiguous DNA nucleosides. This may be achieved by using antisense oligonucleotides or contiguous nucleoside regions thereof with a mixmer design, which comprise sugar modified nucleosides, such as 2' sugar modified nucleosides, and short regions of DNA nucleosides, such as 1, 2 or 3 DNA nucleosides. Mixmers are exemplified herein by every second design, wherein the nucleosides alternate between 1 LNA and 1 DNA nucleoside, e.g. LDLDLDLDLDLD-LDLL, with 5' and 3' terminal LNA nucleosides, and every third design, such as LDDLDDLDDLDDLDDL, where every third nucleoside is a LNA nucleoside.

A totalmer is an antisense oligonucleotide or a contiguous nucleotide sequence thereof which does not comprise DNA or RNA nucleosides, and may for example comprise only 2'-O-MOE nucleosides, such as a fully MOE phosphorothioate, e.g. MMMMMMMMMMMMMMMMMMMMM, where M=2'-O-MOE, or may for example comprise only 2'oMe nucleosides, which are reported to be effective splice modulators for therapeutic use.

Alternatively, a mixmer may comprise a mixture of modified nucleosides, such as MLMLMLMLMLMLMLMLMLML, wherein L=LNA and M=2'-O-MOE nucleosides. Advantageously, the internucleoside linkages in mixmers and totalmers may be phosphorothioate, or a majority of nucleoside linkages in mixmers may be phosphorothioate. Mixmers and totalmers may comprise other internucleoside linkages, such as phosphodiester or phosphorodithioate, by way of example.

Region D' or D" in an Oligonucleotide

The antisense oligonucleotide progranulin agonist of the invention may in some embodiments comprise or consist of the contiguous nucleotide sequence of the oligonucleotide which is complementary to the target nucleic acid, such as a mixmer or totalmer region, and further 5' and/or 3' nucleosides. The further 5' and/or 3' nucleosides may or may not be complementary, such as fully complementary, to the target nucleic acid. Such further 5' and/or 3' nucleosides may be referred to as region D' and D" herein.

The addition of region D' or D" may be used for the purpose of joining the contiguous nucleotide sequence, such as the mixmer or totalmer, to a conjugate moiety or another functional group. When used for joining the contiguous nucleotide sequence with a conjugate moiety is can serve as a biocleavable linker. Alternatively, it may be used to provide exonuclease protection or for ease of synthesis or manufacture.

Region D' or D" may independently comprise or consist of 1, 2, 3, 4 or 5 additional nucleotides, which may be complementary or non-complementary to the target nucleic acid. The nucleotide adjacent to the F or F' region is not a sugar-modified nucleotide, such as a DNA or RNA or base modified versions of these. The D' or D' region may serve as a nuclease susceptible biocleavable linker (see definition of linkers). In some embodiments the additional 5' and/or 3' end nucleotides are linked with phosphodiester linkages, and are DNA or RNA. Nucleotide based biocleavable linkers suitable for use as region D' or D" are disclosed in WO2014/076195, which include by way of example a phosphodiester linked DNA dinucleotide. The use of biocleavable linkers in poly-oligonucleotide constructs is disclosed in WO2015/113922, where they are used to link multiple antisense constructs within a single oligonucleotide.

In one embodiment the antisense oligonucleotide progranulin agonist of the invention comprises a region D' and/or D" in addition to the contiguous nucleotide sequence which constitutes a mixmer or a totalmer.

In some embodiments the internucleoside linkage positioned between region D' or D" and the mixmer or totalmer region is a phosphodiester linkage.

Conjugate

The invention encompasses an antisense oligonucleotide progranulin agonist covalently attached to at least one conjugate moiety. In some embodiments this may be referred to as a conjugate of the invention.

The term "conjugate" as used herein refers to an antisense oligonucleotide progranulin agonist which is covalently linked to a non-nucleotide moiety (conjugate moiety or region C or third region). The conjugate moiety may be covalently linked to the antisense oligonucleotide, optionally via a linker group, such as region D' or D".

Oligonucleotide conjugates and their synthesis has also been reported in comprehensive reviews by Manoharan in Antisense Drug Technology, Principles, Strategies, and Applications, S. T. Crooke, ed., Ch. 16, Marcel Dekker, Inc., 2001 and Manoharan, Antisense and Nucleic Acid Drug Development, 2002, 12, 103.

In some embodiments, the non-nucleotide moiety (conjugate moiety) is selected from the group consisting of carbohydrates (e.g. GalNAc), cell surface receptor ligands, drug substances, hormones, lipophilic substances, polymers, proteins, peptides, toxins (e.g. bacterial toxins), vitamins, viral proteins (e.g. capsids) or combinations thereof.

Linkers

A linkage or linker is a connection between two atoms that links one chemical group or segment of interest to another chemical group or segment of interest via one or more covalent bonds. Conjugate moieties can be attached to the antisense oligonucleotide progranulin agonist directly or through a linking moiety (e.g. linker or tether). Linkers serve to covalently connect a third region, e.g. a conjugate moiety (Region C), to a first region, e.g. an oligonucleotide or contiguous nucleotide sequence complementary to the target nucleic acid (region A).

In some embodiments of the invention the conjugate or antisense oligonucleotide progranulin agonist conjugate of the invention may optionally comprise a linker region (second region or region B and/or region Y) which is positioned between the oligonucleotide or contiguous nucleotide sequence complementary to the target nucleic acid (region A or first region) and the conjugate moiety (region C or third region).

Region B refers to biocleavable linkers comprising or consisting of a physiologically labile bond that is cleavable under conditions normally encountered or analogous to those encountered within a mammalian body. Conditions under which physiologically labile linkers undergo chemical transformation (e.g., cleavage) include chemical conditions such as pH, temperature, oxidative or reductive conditions or agents, and salt concentration found in or analogous to those encountered in mammalian cells. Mammalian intracellular conditions also include the presence of enzymatic activity normally present in a mammalian cell such as from proteolytic enzymes or hydrolytic enzymes or nucleases. In one embodiment the biocleavable linker is susceptible to S1 nuclease cleavage. In some embodiments the nuclease susceptible linker comprises between 1 and 5 nucleosides, such as DNA nucleoside(s) comprising at least two consecutive phosphodiester linkages. Phosphodiester containing biocleavable linkers are described in more detail in WO 2014/076195.

Region Y refers to linkers that are not necessarily biocleavable but primarily serve to covalently connect a conjugate moiety (region C or third region), to an oligonucleotide (region A or first region). The region Y linkers may comprise a chain structure or an oligomer of repeating units such as ethylene glycol, amino acid units or amino alkyl groups The antisense oligonucleotide progranulin agonist conjugates of the present invention can be constructed of the following regional elements A-C, A-B-C, A-B-Y-C, A-Y-B-C or A-Y-C. In some embodiments the linker (region Y) is an amino alkyl, such as a C2-C36 amino alkyl group, including, for example C6 to C12 amino alkyl groups. In some embodiments the linker (region Y) is a C6 amino alkyl group.

Treatment

The term 'treatment' as used herein refers to both treatment of an existing disease (e.g. a disease or disorder as herein referred to), or prevention of a disease, i.e. prophylaxis. It will therefore be recognized that treatment as referred to herein may, in some embodiments, be prophylactic.

DETAILED DESCRIPTION OF THE INVENTION

The inventors have identified that the expression level of the progranulin transcript can be effectively enhanced by targeting the progranulin precursor-mRNA (pre-mRNA) transcript or the progranulin mature mRNA sequence with antisense oligonucleotides, particularly antisense oligonucleotides which comprise high affinity sugar modified nucleosides, such as high affinity 2' sugar modified nucleosides, such as LNA nucleosides or 2'-O-methoxyethyl (MOE) nucleosides.

Described herein are target sites present on the human progranulin nucleic acid target, such as a progranulin precursor-mRNA (pre-mRNA) or mature mRNA sequence, which can be targeted by antisense oligonucleotide agonists of progranulin.

The inventors have surprisingly determined that targeting the 5' UTR and 3' UTR of the progranulin mature mRNA can be particularly effective.

The 5' UTR contains upstream start sites (AUG sites), also known as upstream open reading frames (uORFs). Without wishing to be bound by theory, it is considered that the antisense oligonucleotide progranulin agonists of the invention can increase progranulin production by binding to these regions and affecting, such as reducing, protein translation from these upstream AUG sites. This ensures that protein translation is initiated from the downstream canonical start site (ORF), increasing progranulin production.

The 3' UTR contains binding sites for microRNAs. Without wishing to be bound by theory, it is considered that the antisense oligonucleotide progranulin agonists of the invention may regulate gene expression by binding to these sites in the 3'UTR and preventing microRNA-induced repression of gene expression, leading to increased progranulin production.

Oligonucleotides, such as RNaseH recruiting single stranded antisense oligonucleotides or siRNAs are used extensively in the art to inhibit target RNAs—i.e. are used as antagonists of their complementary nucleic acid target.

The antisense oligonucleotide of the present invention are agonists, i.e. enhance the expression of their complementary target, progranulin nucleic acids, and thereby enhance the expression of progranulin protein. Enhanced progranulin expression is desirable to treat a range of neurological disorders, such as TDP-43 pathologies, or disorders which are characterized by, or caused by progranulin haploinsufficiency.

In certain embodiments the antisense oligonucleotide progranulin agonists of the present invention may enhance the production of their complementary target, progranulin nucleic acids, by at least about 10%. In other embodiments the antisense oligonucleotide progranulin agonists of the present invention may enhance the production of their complementary target, progranulin nucleic acids, by at least about 15%, at least about 20%, at least about 25%, at least about 30%, at least about 35%, at least about 40%, at least about 45%, at least about 50% or more, at least about 60% or more, at least about 70% or more, at least about 80% or more, at least about 90% or more, at least about 100% or more, at least about 200% or more, at least about 300% or more, at least about 400% or more, or at least about 500% or more.

In some embodiments, the antisense oligonucleotide progranulin agonist of the invention or the contiguous nucleotide sequence thereof comprises or consists of 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 contiguous nucleotides in length.

In some embodiments, the entire nucleotide sequence of the antisense oligonucleotide is the contiguous nucleotide sequence.

In some embodiments the contiguous nucleotide sequence is complementary to a 5'UTR region of a human progranulin mature mRNA transcript. The contiguous nucleotide sequence may be fully complementary to a 5'UTR region of a human progranulin mature mRNA transcript. As indicated above, and without wishing to be bound by theory, targeting the 5'UTR may increase progranulin expression by binding to upstream start sites (AUG sites) and affecting, such as reducing, protein translation from these upstream AUG sites. This ensures that protein translation is initiated from the downstream canonical start site (ORF), increasing progranulin production.

In some embodiments the contiguous nucleotide sequence may be complementary to SEQ ID NO 2, SEQ ID NO 689, SEQ ID NO 683, SEQ ID NO 684, SEQ ID NO 685, SEQ ID NO 686, SEQ ID NO 687, SEQ ID NO 688, or a sequence selected from the group consisting of SEQ ID NO 343-586.

In another embodiment the contiguous nucleotide sequence may be complementary to nucleotides 38-246 of SEQ ID NO 1.

In another embodiment the contiguous nucleotide sequence may be fully complementary to SEQ ID NO 2, or SEQ ID NO 689.

In another embodiment the contiguous nucleotide sequence may be fully complementary to a sequence selected from the group consisting of SEQ ID NO 568, SEQ ID NO 571, SEQ ID NO 575, SEQ ID NO 576, SEQ ID NO 577, SEQ ID NO 578, SEQ ID NO 584 & SEQ ID NO 586.

In one embodiment the contiguous nucleotide sequence may a sequence selected from the group consisting of SEQ ID NO 3-342. The invention also contemplates fragments of these contiguous nucleotide sequences, including fragments of at least 8, at least 9, at least 10, at least 11, at least 12, at least 13, at least 14, at least 15, at least 16 or at least 17 contiguous nucleotides thereof.

In certain embodiments the contiguous nucleotide sequence may be selected from the group consisting of SEQ ID NO 105, SEQ ID NO 106, SEQ ID NO 110, SEQ ID NO 113, SEQ ID NO 114, SEQ ID NO 231 and SEQ ID NO 241. The invention also contemplates fragments of these contiguous nucleotide sequences, including fragments of at least 8, at least 9, at least 10, at least 11, at least 12, at least 13, at least 14, at least 15, at least 16 or at least 17 contiguous nucleotides thereof.

In some embodiments the contiguous nucleotide sequence is complementary to a 3'UTR region of a human progranulin mature mRNA transcript. The contiguous nucleotide sequence may be fully complementary to a 3'UTR region of a human progranulin mature mRNA transcript. As indicated above, and without wishing to be bound by theory, the antisense oligonucleotide progranulin agonists of the invention may regulate gene expression by binding to microRNA sites in the 3'UTR and preventing microRNA-induced repression of gene expression, leading to increased progranulin production.

In some embodiments the contiguous nucleotide sequence may be complementary to SEQ ID NO 684, SEQ ID NO 685, SEQ ID NO 686, SEQ ID NO 687, SEQ ID NO 688, or a sequence selected from the group consisting of SEQ ID NO 587-682.

In another embodiment the contiguous nucleotide sequence may be complementary to nucleotides 2039-2346 of SEQ ID NO 1.

In another embodiment the contiguous nucleotide sequence may be fully complementary to SEQ ID NO 684, SEQ ID NO 685, SEQ ID NO 686, SEQ ID NO 687, and SEQ ID NO 688.

In another embodiment the contiguous nucleotide sequence may be fully complementary to a sequence selected from the group consisting of SEQ ID NOs 607, SEQ ID NO 608, SEQ ID NO 609, SEQ ID NO 610, SEQ ID NO 611, SEQ ID NO 612, SEQ ID NO 619, SEQ ID NO 620, SEQ ID NO 633, SEQ ID NO 640, SEQ ID NO 641, SEQ ID NO 645, SEQ ID NO 651, and SEQ ID NO 652.

In some embodiments, the antisense oligonucleotide progranulin agonist or contiguous nucleotide sequence comprises or consists of a sequence selected from the group consisting of sequences SEQ ID NO 3-342. It will be understood that the sequences shown in SEQ ID NO 3-342 may include modified nucleobases which function as the shown nucleobase in base pairing, for example 5-methyl cytosine may be used in place of methyl cytosine. Inosine may be used as a universal base.

In some embodiments, the antisense oligonucleotide progranulin agonist or contiguous nucleotide sequence comprises or consists of 8 to 30 or 8 to 40 nucleotides in length with at least 90% identity, preferably 100% identity, to a sequence selected from the group consisting of SEQ ID NO: 3 to 342. In some embodiments the antisense oligonucleotide progranulin agonist may be 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 nucleotides in length.

Without wishing to be bound by theory, it is considered that the antisense oligonucleotide progranulin agonists of the invention which bind to target sites outside the 5' UTR and 3' UTR regions of the progranulin mature mRNA may increase progranulin protein expression. This increased progranulin protein expression may occur as a result of effects of the antisense oligonucleotide progranulin agonists on secondary regulatory mRNA structures and/or on binding of RNA binding proteins that would otherwise negatively affect protein translation or progranulin mRNA stability.

It is understood that the contiguous nucleobase sequences (motif sequence) can be modified to for example increase nuclease resistance and/or binding affinity to the target nucleic acid.

The pattern in which the modified nucleosides (such as high affinity modified nucleosides) are incorporated into the oligonucleotide sequence is generally termed oligonucleotide design.

The antisense oligonucleotide progranulin agonists of the invention are designed with modified nucleosides and DNA nucleosides. Advantageously, high affinity modified nucleosides are used.

In an embodiment, the oligonucleotide comprises at least 1 modified nucleoside, such as at least 2, at least 3, at least 4, at least 5, at least 6, at least 7, at least 8, at least 9, at least 10, at least 11, at least 12, at least 13, at least 14, at least 15 or at least 16 modified nucleosides.

In an embodiment the oligonucleotide comprises from 1 to 10 modified nucleosides, such as from 2 to 9 modified nucleosides, such as from 3 to 8 modified nucleosides, such as from 4 to 7 modified nucleosides, such as 6 or 7 modified nucleosides. Suitable modifications are described in the "Definitions" section under "modified nucleoside", "high affinity modified nucleosides", "sugar modifications", "2' sugar modifications" and Locked nucleic acids (LNA)".

In an embodiment, the antisense oligonucleotide progranulin agonist comprises one or more sugar modified nucleosides, such as 2' sugar modified nucleosides. Preferably the antisense oligonucleotide progranulin agonist of the invention comprises one or more 2' sugar modified nucleoside independently selected from the group consisting of 2'-O-alkyl-RNA, 2'-O-methyl-RNA (2'oMe), 2'-alkoxy-RNA, 2'-O-methoxyethyl-RNA (2'MOE), 2'-amino-DNA, 2'-fluoro-DNA, arabino nucleic acid (ANA), 2'-fluoro-ANA and LNA nucleosides. It is advantageous if one or more of the modified nucleoside(s) is a locked nucleic acid (LNA).

In a further embodiment the antisense oligonucleotide progranulin agonist comprises at least one modified internucleoside linkage. Suitable internucleoside modifications are described in the "Definitions" section under "Modified internucleoside linkage". It is advantageous if at least 75%, such as all, the internucleoside linkages within the contiguous nucleotide sequence are phosphorothioate or boranophosphate internucleoside linkages. In some embodiments all the internucleotide linkages in the contiguous sequence of the oligonucleotide are phosphorothioate linkages.

An antisense oligonucleotide progranulin agonist may have the structure:

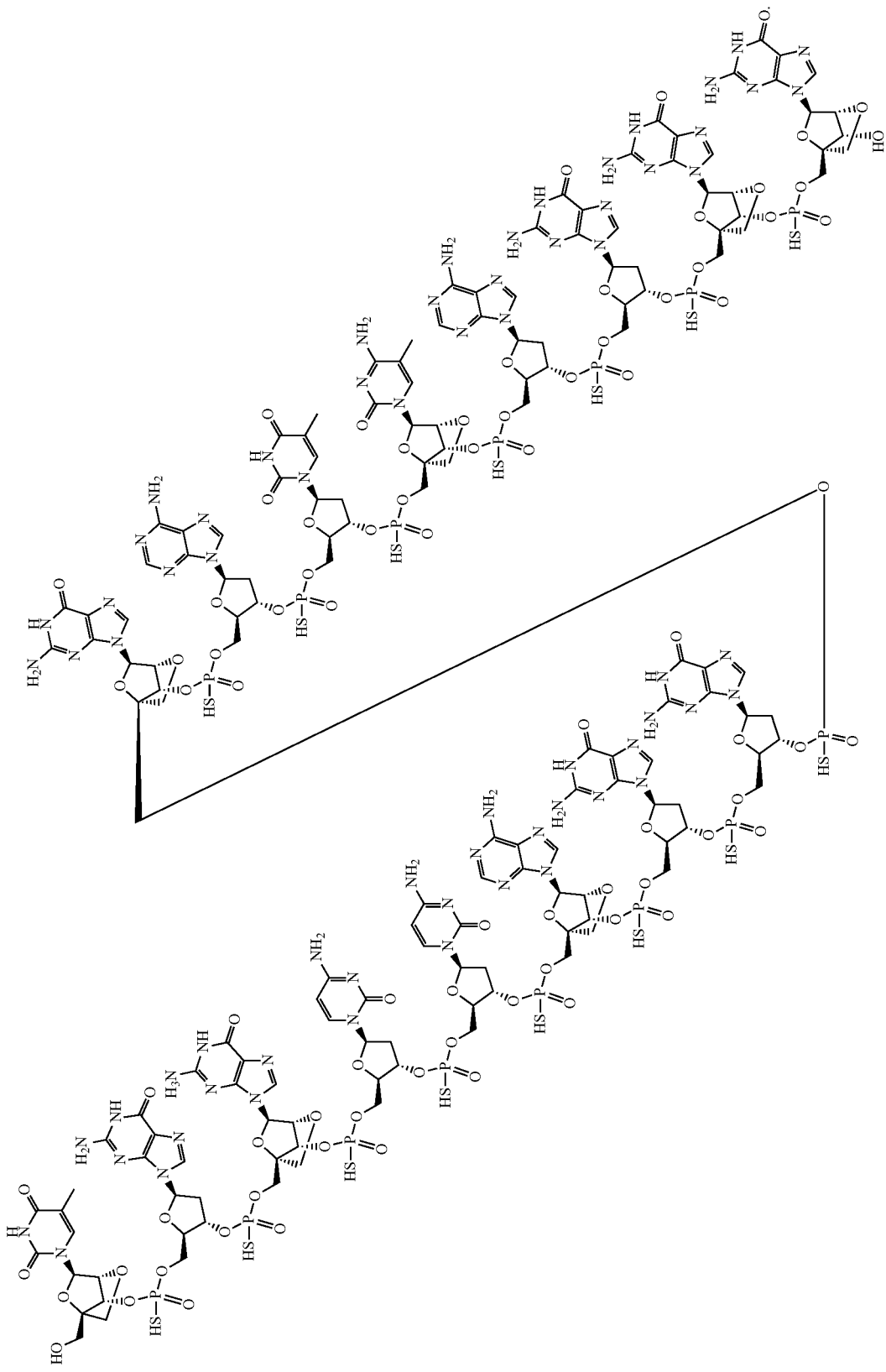

The invention also includes an antisense oligonucleotide progranulin agonist wherein the oligonucleotide is the oligonucleotide compound TgGccAggGatCagGG (SEQ ID NO: 106) wherein capital letters represent beta-D-oxy LNA nucleosides, lowercase letters represent DNA nucleosides, all LNA C are 5-methyl cytosine, and all internucleoside linkages are phosphorothioate internucleoside linkages.

Numbered Paragraphs of the Invention

Aspects of the present invention will now be described by way of numbered paragraphs.

1. An antisense oligonucleotide progranulin agonist, wherein the antisense oligonucleotide is 8-40 nucleotides in length and comprises a contiguous nucleotide sequence of 8-40 nucleotides in length which are fully complementary to a human progranulin pre-mRNA or mRNA transcript, such as SEQ ID NO 1.

2. The antisense oligonucleotide according to paragraph 1, wherein the contiguous nucleotide sequence is of a length of at least 12 nucleotides in length, such as 12-16 or 12-18 nucleotides in length.

3. The antisense oligonucleotide according to paragraph 1 or 2, wherein the contiguous nucleotide sequence is the same length as the antisense oligonucleotide.

4. The antisense oligonucleotide according to any one of paragraphs 1-3, wherein contiguous nucleotide sequence is fully complementary to SEQ ID NO 2, SEQ ID NO 689, SEQ ID NO 683, SEQ ID NO 684, SEQ ID NO 685, SEQ ID NO 686, SEQ ID NO 687, SEQ ID NO 688, or a sequence selected from the group consisting of SEQ ID NO 343-682.

5. The antisense oligonucleotide according to any one of paragraphs 1-4, wherein contiguous nucleotide sequence is fully complementary to a 5'UTR region of a human progranulin mRNA transcript.

6. The antisense oligonucleotide according to any one of paragraphs 1-5, wherein contiguous nucleotide sequence is fully complementary to nucleotides 38-246 of SEQ ID NO 1.

7. The antisense oligonucleotide according to any one of paragraphs 1-6, wherein contiguous nucleotide sequence is fully complementary to SEQ ID NO 2, or SEQ ID NO 689.

8. The antisense oligonucleotide according to any one of paragraphs 1-7, wherein the contiguous nucleotide sequence is fully complementary to a sequence selected from the group consisting of SEQ ID NO 568, 571, 575, 576, 577, 578, 584 & 586.

9. The antisense oligonucleotide according to any one of paragraphs 1-4, wherein contiguous nucleotide sequence is fully complementary to a 3'UTR region of a human progranulin mRNA transcript.

10. The antisense oligonucleotide according to any one of paragraphs 1~4 or 9, wherein contiguous nucleotide sequence is fully complementary to nucleotides 2039-2346 of SEQ ID NO 1.

11. The antisense oligonucleotide according to any one of paragraphs 1-4, 9 or 10 wherein contiguous nucleotide sequence is fully complementary to a sequence selected from the group consisting of SEQ ID NO 684, 685, 683, 686, 687, and 688.

12. The antisense oligonucleotide according to any one of paragraphs 1-4, 9, 10, or 11 wherein contiguous nucleotide sequence is fully complementary to a sequence selected from the group consisting of SEQ ID NOs 607, 608, 609, 610, 611, 612, 619, 620, 633, 640, 641, 645, 651, and 652.

13. The antisense oligonucleotide according to any one of paragraphs 1-12, wherein contiguous nucleotide sequence is a sequence selected from the group consisting of SEQ ID NO 3-342, or at least 8 or at least 10 contiguous nucleotides thereof.

14. The antisense oligonucleotide according to any one of paragraphs 1-13, wherein the oligonucleotide is or comprises an antisense oligonucleotide mixmer or totalmer.

15. The antisense oligonucleotide of any one of paragraphs 1-14, wherein the antisense oligonucleotide or contiguous nucleotide sequence thereof is 10-20 nucleotides in length.

16. The antisense oligonucleotide according to paragraph 1, wherein the antisense oligonucleotide is selected from the group consisting of COMP ID NOs 3-342.

17. A conjugate comprising the antisense oligonucleotide according to any one of paragraphs 1-16, and at least one conjugate moiety covalently attached to said oligonucleotide.

18. A pharmaceutically acceptable salt of the antisense oligonucleotide according to any one of paragraphs 1-16, or the conjugate according to paragraph 17.

19. The pharmaceutically acceptable salt of paragraph 18, wherein the salt is a sodium salt or a potassium salt.

20. A pharmaceutical composition comprising the antisense oligonucleotide of paragraph 1-16 or the conjugate of paragraph 17 and a pharmaceutically acceptable diluent, solvent, carrier, salt and/or adjuvant.

21. A pharmaceutical composition according to paragraph 20, wherein the pharmaceutical composition comprises the antisense oligonucleotide of paragraph 1-16 or the conjugate of paragraph 17, or the pharmaceutically acceptable salt of paragraph 18 or 19 and an aqueous diluent or solvent, such as phosphate buffered saline.

22. An in vivo or in vitro method for enhancing the expression of progranulin in a cell which is expressing progranulin, said method comprising administering an antisense oligonucleotide of any one of paragraphs 1-16 or the conjugate according to paragraph 17, or the salt according to paragraph 18 or 19, or the pharmaceutical composition according to paragraph 20 or 21 in an effective amount to said cell.

23. The method according to paragraph 22, wherein the cell is either a human cell or a mammalian cell.

24. A method for treating or preventing neurological disease comprising administering a therapeutically or prophylactically effective amount of an antisense oligonucleotide of any one of paragraphs 1-16 or the conjugate according to paragraph 17, or the salt according to paragraph 18 or 19, or the pharmaceutical composition according to paragraph 20 or 21 to a subject suffering from or susceptible to neurological disease.

25. The antisense oligonucleotide of any one of paragraphs 1-16 or the conjugate according to paragraph 17, or the salt according to paragraph 18 or 19, or the pharmaceutical composition according to paragraph 20 or 21 for use as a medicament.

26. The an antisense oligonucleotide of any one of paragraphs 1-16 or the conjugate according to paragraph 17, or the salt according to paragraph 18 or 19, or the pharmaceutical composition according to paragraph 20 or 21 for use in the treatment of a neurological disease, such as a TDP-43 pathology.

27. The an antisense oligonucleotide of any one of paragraphs 1-16 or the conjugate according to paragraph 17, or the salt according to paragraph 18 or 19, or the pharmaceutical composition according to paragraph 20 or 21 for use in the treatment of progranulin haploinsufficiency.

28. Use of the antisense oligonucleotide of paragraph 1-16 or the conjugate according to paragraph 17, or the salt according to paragraph 18 or 19, or the pharmaceutical composition according to paragraph 20 or 21 for the preparation of a medicament for treatment or prevention of a neurological disease, such as a TDP-43 pathology.

29. Use of the antisense oligonucleotide of paragraph 1-16 or the conjugate according to paragraph 17, or the salt according to paragraph 18 or 19, or the pharmaceutical composition according to paragraph 20 or 21, for the preparation of a medicament for treatment of progranulin haploinsufficiency.

30. The method or use according to any one of paragraphs 22-29, wherein the method or use is for the treatment of fronto temporal dementia (FTD), neuropathologic frontotemporal lobar degeneration or neuroinflammation.

Numbered Embodiments of the Invention

Numbered embodiments of the present invention will now be described.

1. An antisense oligonucleotide progranulin agonist, wherein the antisense oligonucleotide is 8-40 nucleotides in length and comprises a contiguous nucleotide sequence of 8-40 nucleotides in length which are complementary to a human progranulin pre-mRNA or mRNA transcript.

2. The antisense oligonucleotide progranulin agonist according to embodiment 1, wherein the contiguous nucleotide sequence is of a length of at least 12 nucleotides in length.

3. The antisense oligonucleotide progranulin agonist according to embodiment 1 or embodiment 2, wherein the contiguous nucleotide sequence is the same length as the antisense oligonucleotide.

4. The antisense oligonucleotide progranulin agonist according to any one of embodiments 1-3, wherein the contiguous nucleotide sequence is complementary to a 5'UTR region of a human progranulin mRNA transcript.

5. The antisense oligonucleotide progranulin agonist according to embodiment 4, wherein the contiguous nucleotide sequence is complementary to SEQ ID NO 2, SEQ ID NO 689, SEQ ID NO 683, or a sequence selected from the group consisting of SEQ ID NO 343-586.

6. The antisense oligonucleotide progranulin agonist according to any one of embodiments 1-5, wherein the contiguous nucleotide sequence is selected from SEQ ID NO 105, SEQ ID NO 106, SEQ ID NO 110, SEQ ID NO 113, SEQ ID NO 114, SEQ ID NO 231 and SEQ ID NO 241 or at least 8 or at least 10 contiguous nucleotides thereof.

7. The antisense oligonucleotide progranulin agonist according to any one of embodiments 1-3, wherein contiguous nucleotide sequence is complementary to a 3'UTR region of a human progranulin mRNA transcript.

8. The antisense oligonucleotide progranulin agonist according to embodiment 7, wherein the contiguous nucleotide sequence is complementary to SEQ ID NO 684, SEQ ID NO 685, SEQ ID NO 686, SEQ ID NO 687, SEQ ID NO 688, or a sequence selected from the group consisting of SEQ ID NO 587-682.

9. The antisense oligonucleotide progranulin agonist according to any one of embodiments 1-8, wherein the antisense oligonucleotide progranulin agonist is or comprises an antisense oligonucleotide mixmer or totalmer.

10. An antisense oligonucleotide progranulin agonist having the structure:

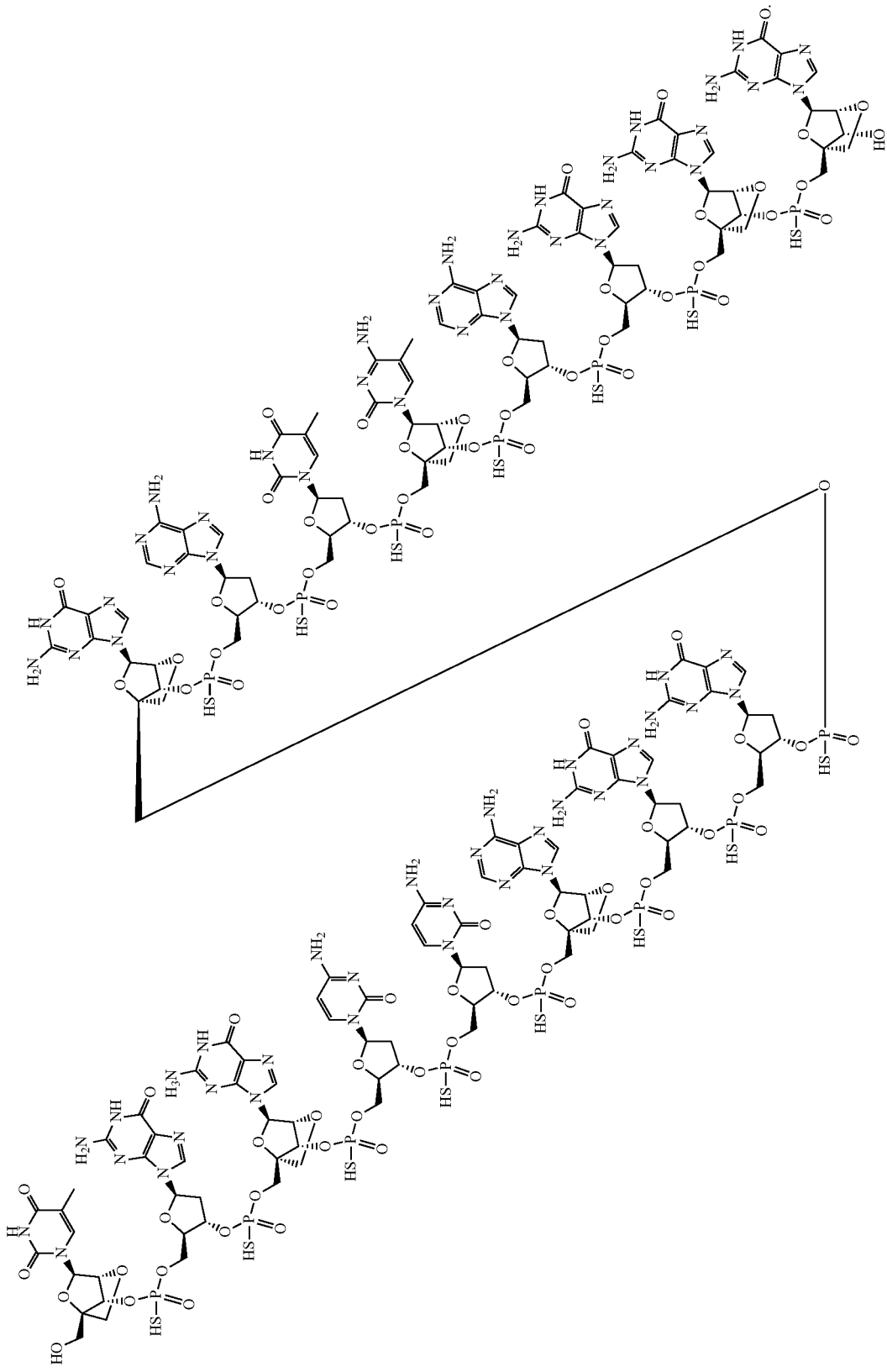

11. An antisense oligonucleotide progranulin agonist wherein the oligonucleotide is the oligonucleotide compound TgGccAggGatCagGG (SEQ ID NO: 106) wherein capital letters represent beta-D-oxy LNA nucleosides, lowercase letters represent DNA nucleosides, all LNA C are 5-methyl cytosine, and all internucleoside linkages are phosphorothioate internucleoside linkages.

12. An in vivo or in vitro method for enhancing the expression of progranulin in a cell which is expressing progranulin, said method comprising administering an antisense oligonucleotide progranulin agonist according to any one of embodiments 1-11 in an effective amount to said cell.

13. The antisense oligonucleotide progranulin agonist according to any one of embodiments 1-11, for use in the treatment of a neurological disease.

14. The antisense oligonucleotide progranulin agonist or pharmaceutical composition for use in the treatment of a neurological disease according to embodiment 13, wherein the neurological disease is a TDP-43 pathology.

15. The antisense oligonucleotide progranulin agonist according to any one of embodiments 1-11 for use in the treatment of progranulin haploinsufficiency.

EXAMPLES

Example 1

GRN 5' UTR Luciferase Reporter Constructs

The GRN 5' UTR sequence (SEQ ID #690) was cloned into the psiCHECK2 plasmid (Promega) immediately in front of the renilla luciferase ATG site using the Q5 site-directed mutagenesis kit (New England Biolabs) according to manufacturer's instruction.

5' UTR sequence from nucleotide number 38 to 256 according to Homo sapiens granulin precursor (GRN), RefSeq NM_002087.3 (SEQ ID NO 1):

```
                                            SEQ 690
ID#GGCGAGAGGAAGCAGGGAGGAGAGTGATTTGAGTAGAAAAGAAACAC

AGCATTCCAGGCTGGCCCCACCTCTATATTGATAAGTAGCCAATGGGAGC

GGGTAGCCCTGATCCCTGGCCAATGGAAACTGAGGTAGGCGGGTCATCGC

GCTGGGGTCTGTAGTCTGAGCGCTACCCGGTTGCTGCTGCCCAAGGACCG

CGGAGTCGGACGCAGGCAGACC
```

For the site-directed mutagenesis and insertion of the GRN 5' UTR the following primers were used:

```
Forward primer
                                        SEQ ID NO 691
5'-ATGGAAACTGAGGTAGGCGGGTCATCGCGCTGGGGTCTGTAGTCTGA

GCGCTACCCGGTTGCTGCTGCCCAAGGACCGCGGAGTCGGACGCAGGCAG

ACCATGGCTTCCAAGGTGTACGACCCCGAGC-3'
and reverse primer
                                        SEQ ID NO 692
5'-TGGCCAGGGATCAGGGCTACCCGCTCCCATTGGCTACTTATCAATAT

AGAGGTGGGGCCAGCCTGGAATGCTGTGTTTCTTTTCTACTCAAATCACT

CTCCTCCCTGCTTCCTCTCGCCGGCTAGCCTATAGTGAGTCGTATTAAGT

AC
```

After transformation of chemical competent bacteria (One Shot TOP10 Chemically Competent E. coli, Thermofisher) and overnight growth on LB agar plates containing ampicillin (imMedia Growth Medium, agar, ampicillin, Thermofisher), single colonies were selected and further grown overnight with constant shaking at 37 Degrees Celcius in LB broth medium containing ampicillin (50 µg/mL) (Thermofisher). Final mini- and midi-prep plasmid purifications were done according to vendors instruction (Qiagen). The inserted 5' UTR GRN sequences were verified using Sanger sequencing (Eurofins Genomics, Ebersberg, Germany).

Example 2

GRN 3' UTR Luciferase Reporter Constructs

The GRN 3' UTR (SEQ ID #2) was cloned into the psiCHECK2 plasmid (Promega) after the renilla luciferase coding sequence using the psiCHECK2 multiple cloning site and the XhoI and NotI restriction sites.

3' UTR sequence from nucleotide number 2039 to 2346 according to Homo sapiens granulin precursor (GRN), RefSeq NM_002087.3 (SEQ ID NO 1).

```
SEQ ID#2:
GGGACAGTACTGAAGACTCTGCAGCCCTCGGGACCCCACTCGGAGGGTGC

CCTCTGCTCAGGCCTCCCTAGACCTCCCCCTAACCAAATTCTCCCTGGAC

CCCATTCTGAGCTCCCCATCACCATGGGAGGTGGGGCCTCAATCTAAGGC

CTTCCCTGTCAGAAGGGGGTTGTGGCAAAAGCCACATTACAAGCTGCCAT

CCCCTCCCCGTTTCAGTGGACCCTGTGGCCAGGTGCTTTTCCCTATCCAC

AGGGGTGTTTGTGTGTGTGCGCGTGTGCGTTTCAATAAAGTTTGTACACT

TTCTTAA
```

Double stranded DNA fragment (gBlock, Integrated DNA technologies) containing the GRN 3' UTR (SEQ ID #2) flanked by XhoI and NotI sites was cut by XhoI and NotI enzymes (New England Biolabs) according to vendors protocol and ligated using T4 Ligase (New England Biolabs) into the previously XhoI/NotI cut psiCHECK2 plasmid.

After transformation of chemical competent bacteria (One Shot® TOP10 Chemically Competent E. coli, Thermofisher) and overnight growth on LB agar plates containing ampicillin (imMedia Growth Medium, agar, ampicillin, Thermofisher), single colonies were selected and further grown overnight with constant shaking at 37 Degrees Celcius in LB broth medium containing ampicillin (50 µg/mL) (Thermofisher). Final mini- and midiprep plasmid purifications were done according to vendors instruction (Qiagen). The inserted 3' UTR GRN sequence was verified using Sanger sequencing (Eurofins Genomics, Ebersberg, Germany).

Example 3 Luciferase Reporter Assays

The day before transfection, 15000 Hela cells per well were seeded in 96-well plates (Nunc™ F96 MicroWell™ White Polystyrene Plates) in 100 µL full growth medium. The day at transfection, media is removed and the transfection mixture consisting of 80 µL Opti-MEM Reduced Serum Medium (ThermoFisher Scientific), 6.25 µg/mL Lipofectamine 2000 (ThermoFisher Scientific) and 100 ng psi-CHECK2 plasmid with 5' UTR/3'UTR of GRN is added to each well according to manufacturer's instructions (ThermoFisher Scientific). Shortly after, 20 µL of Opti-MEM Reduced Serum Medium with 500 nM of each antisense oligonucleotide is added to each well for a final concentration of 100 nM. Wells with seeded cells not exposed to transfection reagents are included to correct for background luciferase activity. After 6 hours incubation, transfection mixture is removed from all wells and replaced with full growth medium. The following day, media is removed and replaced with 75 μL PBS, and the Firefly luciferase activity is measured using the Dual-GLo luciferase system (Promega) according to vendors protocol and the EnSight Multimode Plate Reader (Perkin Elmer). Measurement of The firefly luciferase activity is followed by measurement of the renilla luciferase activity. After correction of the background luciferase activity for each well, the relative luciferase activity is calculated by dividing the Renilla luciferase activity by the firefly luciferase activity for each well to correct for transfection efficiency. Finally, for each antisense oligonucleotides the relative luciferase activity is normalized to PBS transfected cells (PBS=1) and values >1 reflects that the respective antisense oligonucleotides have increased the activity/expression of the renilla luciferase activity.

Example 4

Antisense oligonucleotides were designed for the 5' UTR from position 38 to 241 according to RefSeq NM_002087.3 (SEQ ID NO 1) with one nucleotide basepair shift as shown in table 1, which also provides the data from the luciferase assay, were a value of greater than 1 indicates an increased expression of progranulin (i.e. progranulin agonist activity of the antisense oligonucleotide), and a value lower than 1 indicates a decreased expression of progranulin (i.e. an inhibition or antagonistic effect, on progranulin expression).

TABLE 1

All the antisense oligonucleotides are designed as 16-mers DNA-LNA mixmers with a phosphorothioate backbone. LNA at the very 5' and 3' position and e.g. LNA for every $2^{nd}$ or $3^{rd}$ nucleotide (see Compound table).

| SEQ ID | Compound ID (See Compound Table) | Oligonucleotide Sequence Motif (nucleobase Sequence) | RefSeq NM_002087.3 (SEQ ID NO 1) Start Position | End Position | Target Site Sequence ID | Target Site Sequence | Relative luciferase activity (Relative to PBS) |
|---|---|---|---|---|---|---|---|
| SEQ ID 3 | COMP ID 3 | CCTGCTTCCTCTCGCC | 38 | 53 | SEQ ID 343 | GGCGAGAGGAAGCAGG | 0.47 |
| SEQ ID 4 | COMP ID 4 | CCCTGCTTCCTCTCGC | 39 | 54 | SEQ ID 344 | GCGAGAGGAAGCAGGG | 0.60 |
| SEQ ID 5 | COMP ID 5 | TCCCTGCTTCCTCTCG | 40 | 55 | SEQ ID 345 | CGAGAGGAAGCAGGGA | 0.62 |
| SEQ ID 6 | COMP ID 6 | CTCCCTGCTTCCTCTC | 41 | 56 | SEQ ID 346 | GAGAGGAAGCAGGGAG | 0.65 |
| SEQ ID 7 | COMP ID 7 | CCTCCCTGCTTCCTCT | 42 | 57 | SEQ ID 347 | AGAGGAAGCAGGGAGG | 0.85 |
| SEQ ID 8 | COMP ID 8 | TCCTCCCTGCTTCCTC | 43 | 58 | SEQ ID 348 | GAGGAAGCAGGGAGGA | 0.81 |
| SEQ ID 9 | COMP ID 9 | CTCCTCCCTGCTTCCT | 44 | 59 | SEQ ID 349 | AGGAAGCAGGGAGGAG | 0.53 |
| SEQ ID 10 | COMP ID 10 | TCTCCTCCCTGCTTCC | 45 | 60 | SEQ ID 350 | GGAAGCAGGGAGGAGA | 0.80 |
| SEQ ID 11 | COMP ID 11 | CTCTCCTCCCTGCTTC | 46 | 61 | SEQ ID 351 | GAAGCAGGGAGGAGAG | 0.78 |
| SEQ ID 12 | COMP ID 12 | ACTCTCCTCCCTGCTT | 47 | 62 | SEQ ID 352 | AAGCAGGGAGGAGAGT | 0.78 |
| SEQ ID 13 | COMP ID 13 | CACTCTCCTCCCTGCT | 48 | 63 | SEQ ID 353 | AGCAGGGAGGAGAGTG | 0.53 |
| SEQ ID 14 | COMP ID 14 | TCACTCTCCTCCCTGC | 49 | 64 | SEQ ID 354 | GCAGGGAGGAGAGTGA | 0.66 |
| SEQ ID 15 | COMP ID 15 | ATCACTCTCCTCCCTG | 50 | 65 | SEQ ID 355 | CAGGGAGGAGAGTGAT | n.d. |
| SEQ ID 16 | COMP ID 16 | AATCACTCTCCTCCCT | 51 | 66 | SEQ ID 356 | AGGGAGGAGAGTGATT | n.d. |
| SEQ ID 17 | COMP ID 17 | AAATCACTCTCCTCCC | 52 | 67 | SEQ ID 357 | GGGAGGAGAGTGATTT | n.d. |
| SEQ ID 18 | COMP ID 18 | CAAATCACTCTCCTCC | 53 | 68 | SEQ ID 358 | GGAGGAGAGTGATTTG | n.d. |
| SEQ ID 19 | COMP ID 19 | TCAAATCACTCTCCTC | 54 | 69 | SEQ ID 359 | GAGGAGAGTGATTTGA | 0.56 |
| SEQ ID 20 | COMP ID 20 | CTCAAATCACTCTCCT | 55 | 70 | SEQ ID 360 | AGGAGAGTGATTTGAG | 0.58 |
| SEQ ID 21 | COMP ID 21 | ACTCAAATCACTCTCC | 56 | 71 | SEQ ID 361 | GGAGAGTGATTTGAGT | 0.50 |
| SEQ ID 22 | COMP ID 22 | TACTCAAATCACTCTC | 57 | 72 | SEQ ID 362 | GAGAGTGATTTGAGTA | 0.44 |
| SEQ ID 23 | COMP ID 23 | CTACTCAAATCACTCT | 58 | 73 | SEQ ID 363 | AGAGTGATTTGAGTAG | 0.61 |
| SEQ ID 24 | COMP ID 24 | TCTACTCAAATCACTC | 59 | 74 | SEQ ID 364 | GAGTGATTTGAGTAGA | 0.44 |
| SEQ ID 25 | COMP ID 25 | TTCTACTCAAATCACT | 60 | 75 | SEQ ID 365 | AGTGATTTGAGTAGAA | 0.47 |
| SEQ ID 26 | COMP ID 26 | TTTCTACTCAAATCAC | 61 | 76 | SEQ ID 366 | GTGATTTGAGTAGAAA | 0.57 |

TABLE 1-continued

All the antisense oligonucleotides are designed as 16-mers DNA-LNA mixmers with a phosphorothioate backbone. LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | RefSeq NM_002087.3 (SEQ ID NO 1) Start Position | End Position | Target Site Sequence ID | Target Site Sequence | Relative luciferase activity (Relative to PBS) |
|---|---|---|---|---|---|---|---|
| SEQ ID 27 | COMP ID 27 | TTTTCTACTCAAATCA | 62 | 77 | SEQ ID 367 | TGATTTGAGTAGAAAA | 0.49 |
| SEQ ID 28 | COMP ID 28 | CTTTTCTACTCAAATC | 63 | 78 | SEQ ID 368 | GATTTGAGTAGAAAAG | 0.54 |
| SEQ ID 29 | COMP ID 29 | TCTTTTCTACTCAAAT | 64 | 79 | SEQ ID 369 | ATTTGAGTAGAAAAGA | 0.49 |
| SEQ ID 30 | COMP ID 30 | TTCTTTTCTACTCAAA | 65 | 80 | SEQ ID 370 | TTTGAGTAGAAAAGAA | 0.38 |
| SEQ ID 31 | COMP ID 31 | TTTCTTTTCTACTCAA | 66 | 81 | SEQ ID 371 | TTGAGTAGAAAAGAAA | 0.59 |
| SEQ ID 32 | COMP ID 32 | GTTTCTTTTCTACTCA | 67 | 82 | SEQ ID 372 | TGAGTAGAAAAGAAAC | 0.44 |
| SEQ ID 33 | COMP ID 33 | TGTTTCTTTTCTACTC | 68 | 83 | SEQ ID 373 | GAGTAGAAAAGAAACA | 0.61 |
| SEQ ID 34 | COMP ID 34 | GTGTTTCTTTTCTACT | 69 | 84 | SEQ ID 374 | AGTAGAAAAGAAACAC | 0.56 |
| SEQ ID 35 | COMP ID 35 | TGTGTTTCTTTTCTAC | 70 | 85 | SEQ ID 375 | GTAGAAAAGAAACACA | 0.47 |
| SEQ ID 36 | COMP ID 36 | CTGTGTTTCTTTTCTA | 71 | 86 | SEQ ID 376 | TAGAAAAGAAACACAG | 0.36 |
| SEQ ID 37 | COMP ID 37 | GCTGTGTTTCTTTTCT | 72 | 87 | SEQ ID 377 | AGAAAAGAAACACAGC | 0.45 |
| SEQ ID 38 | COMP ID 38 | TGCTGTGTTTCTTTTC | 73 | 88 | SEQ ID 378 | GAAAAGAAACACAGCA | 0.58 |
| SEQ ID 39 | COMP ID 39 | ATGCTGTGTTTCTTTT | 74 | 89 | SEQ ID 379 | AAAAGAAACACAGCAT | 0.77 |
| SEQ ID 40 | COMP ID 40 | AATGCTGTGTTTCTTT | 75 | 90 | SEQ ID 380 | AAAGAAACACAGCATT | 0.53 |
| SEQ ID 41 | COMP ID 41 | GAATGCTGTGTTTCTT | 76 | 91 | SEQ ID 381 | AAGAAACACAGCATTC | 0.73 |
| SEQ ID 42 | COMP ID 42 | GGAATGCTGTGTTTCT | 77 | 92 | SEQ ID 382 | AGAAACACAGCATTCC | 0.77 |
| SEQ ID 43 | COMP ID 43 | TGGAATGCTGTGTTTC | 78 | 93 | SEQ ID 383 | GAAACACAGCATTCCA | 0.69 |
| SEQ ID 44 | COMP ID 44 | CTGGAATGCTGTGTTT | 79 | 94 | SEQ ID 384 | AAACACAGCATTCCAG | 0.63 |
| SEQ ID 45 | COMP ID 45 | CCTGGAATGCTGTGTT | 80 | 95 | SEQ ID 385 | AACACAGCATTCCAGG | 0.58 |
| SEQ ID 46 | COMP ID 46 | GCCTGGAATGCTGTGT | 81 | 96 | SEQ ID 386 | ACACAGCATTCCAGGC | 0.57 |
| SEQ ID 47 | COMP ID 47 | AGCCTGGAATGCTGTG | 82 | 97 | SEQ ID 387 | CACAGCATTCCAGGCT | 0.48 |
| SEQ ID 48 | COMP ID 48 | CAGCCTGGAATGCTGT | 83 | 98 | SEQ ID 388 | ACAGCATTCCAGGCTG | 0.62 |
| SEQ ID 49 | COMP ID 49 | CCAGCCTGGAATGCTG | 84 | 99 | SEQ ID 389 | CAGCATTCCAGGCTGG | 0.40 |
| SEQ ID 50 | COMP ID 50 | GCCAGCCTGGAATGCT | 85 | 100 | SEQ ID 390 | AGCATTCCAGGCTGGC | 0.32 |
| SEQ ID 51 | COMP ID 51 | GGCCAGCCTGGAATGC | 86 | 101 | SEQ ID 391 | GCATTCCAGGCTGGCC | 0.24 |
| SEQ ID 52 | COMP ID 52 | GGGCCAGCCTGGAATG | 87 | 102 | SEQ ID 392 | CATTCCAGGCTGGCCC | 0.15 |
| SEQ ID 53 | COMP ID 53 | GGGGCCAGCCTGGAAT | 88 | 103 | SEQ ID 393 | ATTCCAGGCTGGCCCC | 0.20 |
| SEQ ID 54 | COMP ID 54 | TGGGGCCAGCCTGGAA | 89 | 104 | SEQ ID 394 | TTCCAGGCTGGCCCCA | 0.62 |
| SEQ ID 55 | COMP ID 55 | GTGGGGCCAGCCTGGA | 90 | 105 | SEQ ID 395 | TCCAGGCTGGCCCCAC | 0.54 |
| SEQ ID 56 | COMP ID 56 | GGTGGGGCCAGCCTGG | 91 | 106 | SEQ ID 396 | CCAGGCTGGCCCCACC | 0.62 |
| SEQ ID 57 | COMP ID 57 | AGGTGGGGCCAGCCTG | 92 | 107 | SEQ ID 397 | CAGGCTGGCCCCACCT | 0.38 |
| SEQ ID 58 | COMP ID 58 | GAGGTGGGGCCAGCCT | 93 | 108 | SEQ ID 398 | AGGCTGGCCCCACCTC | 0.46 |
| SEQ ID 59 | COMP ID 59 | AGAGGTGGGGCCAGCC | 94 | 109 | SEQ ID 399 | GGCTGGCCCCACCTCT | 0.32 |
| SEQ ID 60 | COMP ID 60 | TAGAGGTGGGGCCAGC | 95 | 110 | SEQ ID 400 | GCTGGCCCCACCTCTA | 0.53 |
| SEQ ID 61 | COMP ID 61 | ATAGAGGTGGGGCCAG | 96 | 111 | SEQ ID 401 | CTGGCCCCACCTCTAT | 0.37 |

TABLE 1-continued

All the antisense oligonucleotides are designed as 16-mers DNA-LNA mixmers with a phosphorothioate backbone. LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | RefSeq NM_002087.3 (SEQ ID NO 1) Start Position | End Position | Target Site Sequence ID | Target Site Sequence | Relative luciferase activity (Relative to PBS) |
|---|---|---|---|---|---|---|---|
| SEQ ID 62 | COMP ID 62 | TATAGAGGTGGGGCCA | 97 | 112 | SEQ ID 402 | TGGCCCCACCTCTATA | 0.68 |
| SEQ ID 63 | COMP ID 63 | ATATAGAGGTGGGGCC | 98 | 113 | SEQ ID 403 | GGCCCCACCTCTATAT | 0.65 |
| SEQ ID 64 | COMP ID 64 | AATATAGAGGTGGGGC | 99 | 114 | SEQ ID 404 | GCCCCACCTCTATATT | 0.61 |
| SEQ ID 65 | COMP ID 65 | CAATATAGAGGTGGGG | 100 | 115 | SEQ ID 405 | CCCCACCTCTATATTG | 0.79 |
| SEQ ID 66 | COMP ID 66 | TCAATATAGAGGTGGG | 101 | 116 | SEQ ID 406 | CCCACCTCTATATTGA | 0.86 |
| SEQ ID 67 | COMP ID 67 | ATCAATATAGAGGTGG | 102 | 117 | SEQ ID 407 | CCACCTCTATATTGAT | 0.80 |
| SEQ ID 68 | COMP ID 68 | TATCAATATAGAGGTG | 103 | 118 | SEQ ID 408 | CACCTCTATATTGATA | 0.65 |
| SEQ ID 69 | COMP ID 69 | TTATCAATATAGAGGT | 104 | 119 | SEQ ID 409 | ACCTCTATATTGATAA | 0.49 |
| SEQ ID 70 | COMP ID 70 | CTTATCAATATAGAGG | 105 | 120 | SEQ ID 410 | CCTCTATATTGATAAG | 0.93 |
| SEQ ID 71 | COMP ID 71 | ACTTATCAATATAGAG | 106 | 121 | SEQ ID 411 | CTCTATATTGATAAGT | 0.73 |
| SEQ ID 72 | COMP ID 72 | TACTTATCAATATAGA | 107 | 122 | SEQ ID 412 | TCTATATTGATAAGTA | 0.87 |
| SEQ ID 73 | COMP ID 73 | CTACTTATCAATATAG | 108 | 123 | SEQ ID 413 | CTATATTGATAAGTAG | 0.83 |
| SEQ ID 74 | COMP ID 74 | GCTACTTATCAATATA | 109 | 124 | SEQ ID 414 | TATATTGATAAGTAGC | 0.64 |
| SEQ ID 75 | COMP ID 75 | GGCTACTTATCAATAT | 110 | 125 | SEQ ID 415 | ATATTGATAAGTAGCC | 0.71 |
| SEQ ID 76 | COMP ID 76 | TGGCTACTTATCAATA | 111 | 126 | SEQ ID 416 | TATTGATAAGTAGCCA | 0.81 |
| SEQ ID 77 | COMP ID 77 | TTGGCTACTTATCAAT | 112 | 127 | SEQ ID 417 | ATTGATAAGTAGCCAA | 0.48 |
| SEQ ID 78 | COMP ID 78 | ATTGGCTACTTATCAA | 113 | 128 | SEQ ID 418 | TTGATAAGTAGCCAAT | 0.88 |
| SEQ ID 79 | COMP ID 79 | CATTGGCTACTTATCA | 114 | 129 | SEQ ID 419 | TGATAAGTAGCCAATG | 0.72 |
| SEQ ID 80 | COMP ID 80 | CCATTGGCTACTTATC | 115 | 130 | SEQ ID 420 | GATAAGTAGCCAATGG | 0.53 |
| SEQ ID 81 | COMP ID 81 | CCCATTGGCTACTTAT | 116 | 131 | SEQ ID 421 | ATAAGTAGCCAATGGG | 0.63 |
| SEQ ID 82 | COMP ID 82 | TCCCATTGGCTACTTA | 117 | 132 | SEQ ID 422 | TAAGTAGCCAATGGGA | 0.53 |
| SEQ ID 83 | COMP ID 83 | CTCCCATTGGCTACTT | 118 | 133 | SEQ ID 423 | AAGTAGCCAATGGGAG | 0.57 |
| SEQ ID 84 | COMP ID 84 | GCTCCCATTGGCTACT | 119 | 134 | SEQ ID 424 | AGTAGCCAATGGGAGC | 0.52 |
| SEQ ID 85 | COMP ID 85 | CGCTCCCATTGGCTAC | 120 | 135 | SEQ ID 425 | GTAGCCAATGGGAGCG | 0.25 |
| SEQ ID 86 | COMP ID 86 | CCGCTCCCATTGGCTA | 121 | 136 | SEQ ID 426 | TAGCCAATGGGAGCGG | 0.37 |
| SEQ ID 87 | COMP ID 87 | CCCGCTCCCATTGGCT | 122 | 137 | SEQ ID 427 | AGCCAATGGGAGCGGG | 0.28 |
| SEQ ID 88 | COMP ID 88 | ACCCGCTCCCATTGGC | 123 | 138 | SEQ ID 428 | GCCAATGGGAGCGGGT | 0.30 |
| SEQ ID 89 | COMP ID 89 | TACCCGCTCCCATTGG | 124 | 139 | SEQ ID 429 | CCAATGGGAGCGGGTA | 0.43 |
| SEQ ID 90 | COMP ID 90 | CTACCCGCTCCCATTG | 125 | 140 | SEQ ID 430 | CAATGGGAGCGGGTAG | 0.38 |
| SEQ ID 91 | COMP ID 91 | GCTACCCGCTCCCATT | 126 | 141 | SEQ ID 431 | AATGGGAGCGGGTAGC | 0.65 |
| SEQ ID 92 | COMP ID 92 | GGCTACCCGCTCCCAT | 127 | 142 | SEQ ID 432 | ATGGGAGCGGGTAGCC | 0.51 |
| SEQ ID 93 | COMP ID 93 | GGGCTACCCGCTCCCA | 128 | 143 | SEQ ID 433 | TGGGAGCGGGTAGCCC | 0.38 |
| SEQ ID 94 | COMP ID 94 | AGGGCTACCCGCTCCC | 129 | 144 | SEQ ID 434 | GGGAGCGGGTAGCCCT | 0.50 |
| SEQ ID 95 | COMP ID 95 | CAGGGCTACCCGCTCC | 130 | 145 | SEQ ID 435 | GGAGCGGGTAGCCCTG | 0.45 |

TABLE 1-continued

All the antisense oligonucleotides are designed as 16-mers DNA-LNA mixmers with a phosphorothioate backbone. LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | RefSeq NM_002087.3 (SEQ ID NO 1) Start Position | End Position | Target Site Sequence ID | Target Site Sequence | Relative luciferase activity (Relative to PBS) |
|---|---|---|---|---|---|---|---|
| SEQ ID 96 | COMP ID 96 | TCAGGGCTACCCGCTC | 131 | 146 | SEQ ID 436 | GAGCGGGTAGCCCTGA | 0.50 |
| SEQ ID 97 | COMP ID 97 | ATCAGGGCTACCCGCT | 132 | 147 | SEQ ID 437 | AGCGGGTAGCCCTGAT | 0.39 |
| SEQ ID 98 | COMP ID 98 | GATCAGGGCTACCCGC | 133 | 148 | SEQ ID 438 | GCGGGTAGCCCTGATC | 0.31 |
| SEQ ID 99 | COMP ID 99 | GGATCAGGGCTACCCG | 134 | 149 | SEQ ID 439 | CGGGTAGCCCTGATCC | 0.32 |
| SEQ ID 100 | COMP ID 100 | GGGATCAGGGCTACCC | 135 | 150 | SEQ ID 440 | GGGTAGCCCTGATCCC | 0.56 |
| SEQ ID 101 | COMP ID 101 | AGGGATCAGGGCTACC | 136 | 151 | SEQ ID 441 | GGTAGCCCTGATCCCT | 0.41 |
| SEQ ID 102 | COMP ID 102 | CAGGGATCAGGGCTAC | 137 | 152 | SEQ ID 442 | GTAGCCCTGATCCCTG | 0.86 |
| SEQ ID 103 | COMP ID 103 | CCAGGGATCAGGGCTA | 138 | 153 | SEQ ID 443 | TAGCCCTGATCCCTGG | 0.65 |
| SEQ ID 104 | COMP ID 104 | GCCAGGGATCAGGGCT | 139 | 154 | SEQ ID 444 | AGCCCTGATCCCTGGC | 0.65 |
| SEQ ID 105 | COMP ID 105 | GGCCAGGGATCAGGGC | 140 | 155 | SEQ ID 445 | GCCCTGATCCCTGGCC | 1.00 |
| SEQ ID 106 | COMP ID 106 | TGGCCAGGGATCAGGG | 141 | 156 | SEQ ID 446 | CCCTGATCCCTGGCCA | 1.07 |
| SEQ ID 107 | COMP ID 107 | TTGGCCAGGGATCAGG | 142 | 157 | SEQ ID 447 | CCTGATCCCTGGCCAA | 0.52 |
| SEQ ID 108 | COMP ID 108 | ATTGGCCAGGGATCAG | 143 | 158 | SEQ ID 448 | CTGATCCCTGGCCAAT | 0.86 |
| SEQ ID 109 | COMP ID 109 | CATTGGCCAGGGATCA | 144 | 159 | SEQ ID 449 | TGATCCCTGGCCAATG | 0.67 |
| SEQ ID 110 | COMP ID 110 | CCATTGGCCAGGGATC | 145 | 160 | SEQ ID 450 | GATCCCTGGCCAATGG | 0.54 |
| SEQ ID 111 | COMP ID 111 | TCCATTGGCCAGGGAT | 146 | 161 | SEQ ID 451 | ATCCCTGGCCAATGGA | n.d. |
| SEQ ID 112 | COMP ID 112 | TTCCATTGGCCAGGGA | 147 | 162 | SEQ ID 452 | TCCCTGGCCAATGGAA | n.d. |
| SEQ ID 113 | COMP ID 113 | TTTCCATTGGCCAGGG | 148 | 163 | SEQ ID 453 | CCCTGGCCAATGGAAA | n.d. |
| SEQ ID 114 | COMP ID 114 | GTTTCCATTGGCCAGG | 149 | 164 | SEQ ID 454 | CCTGGCCAATGGAAAC | n.d. |
| SEQ ID 115 | COMP ID 115 | AGTTTCCATTGGCCAG | 150 | 165 | SEQ ID 455 | CTGGCCAATGGAAACT | 0.43 |
| SEQ ID 116 | COMP ID 116 | CAGTTTCCATTGGCCA | 151 | 166 | SEQ ID 456 | TGGCCAATGGAAACTG | 0.56 |
| SEQ ID 117 | COMP ID 117 | TCAGTTTCCATTGGCC | 152 | 167 | SEQ ID 457 | GGCCAATGGAAACTGA | 0.61 |
| SEQ ID 118 | COMP ID 118 | CTCAGTTTCCATTGGC | 153 | 168 | SEQ ID 458 | GCCAATGGAAACTGAG | 0.71 |
| SEQ ID 119 | COMP ID 119 | CCTCAGTTTCCATTGG | 154 | 169 | SEQ ID 459 | CCAATGGAAACTGAGG | 1.03 |
| SEQ ID 120 | COMP ID 120 | ACCTCAGTTTCCATTG | 155 | 170 | SEQ ID 460 | CAATGGAAACTGAGGT | 0.90 |
| SEQ ID 121 | COMP ID 121 | TACCTCAGTTTCCATT | 156 | 171 | SEQ ID 461 | AATGGAAACTGAGGTA | 0.95 |
| SEQ ID 122 | COMP ID 122 | CTACCTCAGTTTCCAT | 157 | 172 | SEQ ID 462 | ATGGAAACTGAGGTAG | 0.63 |
| SEQ ID 123 | COMP ID 123 | CCTACCTCAGTTTCCA | 158 | 173 | SEQ ID 463 | TGGAAACTGAGGTAGG | 0.62 |
| SEQ ID 124 | COMP ID 124 | GCCTACCTCAGTTTCC | 159 | 174 | SEQ ID 464 | GGAAACTGAGGTAGGC | 0.49 |
| SEQ ID 125 | COMP ID 125 | CGCCTACCTCAGTTTC | 160 | 175 | SEQ ID 465 | GAAACTGAGGTAGGCG | 1.18 |
| SEQ ID 126 | COMP ID 126 | CCGCCTACCTCAGTTT | 161 | 176 | SEQ ID 466 | AAACTGAGGTAGGCGG | 0.55 |
| SEQ ID 127 | COMP ID 127 | CCCGCCTACCTCAGTT | 162 | 177 | SEQ ID 467 | AACTGAGGTAGGCGGG | 0.72 |
| SEQ ID 128 | COMP ID 128 | ACCCGCCTACCTCAGT | 163 | 178 | SEQ ID 468 | ACTGAGGTAGGCGGGT | 0.44 |
| SEQ ID 129 | COMP ID 129 | GACCCGCCTACCTCAG | 164 | 179 | SEQ ID 469 | CTGAGGTAGGCGGGTC | 0.42 |
| SEQ ID 130 | COMP ID 130 | TGACCCGCCTACCTCA | 165 | 180 | SEQ ID 470 | TGAGGTAGGCGGGTCA | 0.28 |

TABLE 1-continued

All the antisense oligonucleotides are designed as 16-mers DNA-LNA mixmers with a phosphorothioate backbone. LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | RefSeq NM_002087.3 (SEQ ID NO 1) Start Position | End Position | Target Site Sequence ID | Target Site Sequence | Relative luciferase activity (Relative to PBS) |
|---|---|---|---|---|---|---|---|
| SEQ ID 131 | COMP ID 131 | ATGACCCGCCTACCTC | 166 | 181 | SEQ ID 471 | GAGGTAGGCGGGTCAT | 0.19 |
| SEQ ID 132 | COMP ID 132 | GATGACCCGCCTACCT | 167 | 182 | SEQ ID 472 | AGGTAGGCGGGTCATC | 0.18 |
| SEQ ID 133 | COMP ID 133 | CGATGACCCGCCTACC | 168 | 183 | SEQ ID 473 | GGTAGGCGGGTCATCG | 0.34 |
| SEQ ID 134 | COMP ID 134 | GCGATGACCCGCCTAC | 169 | 184 | SEQ ID 474 | GTAGGCGGGTCATCGC | 0.73 |
| SEQ ID 135 | COMP ID 135 | CGCGATGACCCGCCTA | 170 | 185 | SEQ ID 475 | TAGGCGGGTCATCGCG | 0.66 |
| SEQ ID 136 | COMP ID 136 | GCGCGATGACCCGCCT | 171 | 186 | SEQ ID 476 | AGGCGGGTCATCGCGC | 0.46 |
| SEQ ID 137 | COMP ID 137 | AGCGCGATGACCCGCC | 172 | 187 | SEQ ID 477 | GGCGGGTCATCGCGCT | 0.46 |
| SEQ ID 138 | COMP ID 138 | CAGCGCGATGACCCGC | 173 | 188 | SEQ ID 478 | GCGGGTCATCGCGCTG | 0.53 |
| SEQ ID 139 | COMP ID 139 | CCAGCGCGATGACCCG | 174 | 189 | SEQ ID 479 | CGGGTCATCGCGCTGG | 0.23 |
| SEQ ID 140 | COMP ID 140 | CCCAGCGCGATGACCC | 175 | 190 | SEQ ID 480 | GGGTCATCGCGCTGGG | 0.23 |
| SEQ ID 141 | COMP ID 141 | CCCCAGCGCGATGACC | 176 | 191 | SEQ ID 481 | GGTCATCGCGCTGGGG | 0.42 |
| SEQ ID 142 | COMP ID 142 | ACCCCAGCGCGATGAC | 177 | 192 | SEQ ID 482 | GTCATCGCGCTGGGGT | 0.30 |
| SEQ ID 143 | COMP ID 143 | GACCCCAGCGCGATGA | 178 | 193 | SEQ ID 483 | TCATCGCGCTGGGGTC | 0.63 |
| SEQ ID 144 | COMP ID 144 | AGACCCCAGCGCGATG | 179 | 194 | SEQ ID 484 | CATCGCGCTGGGGTCT | 0.57 |
| SEQ ID 145 | COMP ID 145 | CAGACCCCAGCGCGAT | 180 | 195 | SEQ ID 485 | ATCGCGCTGGGGTCTG | 0.31 |
| SEQ ID 146 | COMP ID 146 | ACAGACCCCAGCGCGA | 181 | 196 | SEQ ID 486 | TCGCGCTGGGGTCTGT | 0.29 |
| SEQ ID 147 | COMP ID 147 | TACAGACCCCAGCGCG | 182 | 197 | SEQ ID 487 | CGCGCTGGGGTCTGTA | 0.34 |
| SEQ ID 148 | COMP ID 148 | CTACAGACCCCAGCGC | 183 | 198 | SEQ ID 488 | GCGCTGGGGTCTGTAG | 0.32 |
| SEQ ID 149 | COMP ID 149 | ACTACAGACCCCAGCG | 184 | 199 | SEQ ID 489 | CGCTGGGGTCTGTAGT | 0.34 |
| SEQ ID 150 | COMP ID 150 | GACTACAGACCCCAGC | 185 | 200 | SEQ ID 490 | GCTGGGGTCTGTAGTC | 0.64 |
| SEQ ID 151 | COMP ID 151 | AGACTACAGACCCCAG | 186 | 201 | SEQ ID 491 | CTGGGGTCTGTAGTCT | 0.95 |
| SEQ ID 152 | COMP ID 152 | CAGACTACAGACCCCA | 187 | 202 | SEQ ID 492 | TGGGGTCTGTAGTCTG | 0.52 |
| SEQ ID 153 | COMP ID 153 | TCAGACTACAGACCCC | 188 | 203 | SEQ ID 493 | GGGGTCTGTAGTCTGA | 0.53 |
| SEQ ID 154 | COMP ID 154 | CTCAGACTACAGACCC | 189 | 204 | SEQ ID 494 | GGGTCTGTAGTCTGAG | 0.43 |
| SEQ ID 155 | COMP ID 155 | GCTCAGACTACAGACC | 190 | 205 | SEQ ID 495 | GGTCTGTAGTCTGAGC | 0.33 |
| SEQ ID 156 | COMP ID 156 | CGCTCAGACTACAGAC | 191 | 206 | SEQ ID 496 | GTCTGTAGTCTGAGCG | 0.43 |
| SEQ ID 157 | COMP ID 157 | GCGCTCAGACTACAGA | 192 | 207 | SEQ ID 497 | TCTGTAGTCTGAGCGC | 0.46 |
| SEQ ID 158 | COMP ID 158 | AGCGCTCAGACTACAG | 193 | 208 | SEQ ID 498 | CTGTAGTCTGAGCGCT | 0.80 |
| SEQ ID 159 | COMP ID 159 | TAGCGCTCAGACTACA | 194 | 209 | SEQ ID 499 | TGTAGTCTGAGCGCTA | 0.47 |
| SEQ ID 160 | COMP ID 160 | GTAGCGCTCAGACTAC | 195 | 210 | SEQ ID 500 | GTAGTCTGAGCGCTAC | 0.67 |
| SEQ ID 161 | COMP ID 161 | GGTAGCGCTCAGACTA | 196 | 211 | SEQ ID 501 | TAGTCTGAGCGCTACC | 0.74 |
| SEQ ID 162 | COMP ID 162 | GGGTAGCGCTCAGACT | 197 | 212 | SEQ ID 502 | AGTCTGAGCGCTACCC | 0.62 |
| SEQ ID 163 | COMP ID 163 | CGGGTAGCGCTCAGAC | 198 | 213 | SEQ ID 503 | GTCTGAGCGCTACCCG | 0.43 |
| SEQ ID 164 | COMP ID 164 | CCGGGTAGCGCTCAGA | 199 | 214 | SEQ ID 504 | TCTGAGCGCTACCCGG | 0.38 |

TABLE 1-continued

All the antisense oligonucleotides are designed as 16-mers DNA-LNA mixmers with a phosphorothioate backbone. LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | RefSeq NM_002087.3 (SEQ ID NO 1) Start Position | End Position | Target Site Sequence ID | Target Site Sequence | Relative luciferase activity (Relative to PBS) |
|---|---|---|---|---|---|---|---|
| SEQ ID 165 | COMP ID 165 | ACCGGGTAGCGCTCAG | 200 | 215 | SEQ ID 505 | CTGAGCGCTACCCGGT | 0.45 |
| SEQ ID 166 | COMP ID 166 | AACCGGGTAGCGCTCA | 201 | 216 | SEQ ID 506 | TGAGCGCTACCCGGTT | 0.61 |
| SEQ ID 167 | COMP ID 167 | CAACCGGGTAGCGCTC | 202 | 217 | SEQ ID 507 | GAGCGCTACCCGGTTG | 0.56 |
| SEQ ID 168 | COMP ID 168 | GCAACCGGGTAGCGCT | 203 | 218 | SEQ ID 508 | AGCGCTACCCGGTTGC | 0.50 |
| SEQ ID 169 | COMP ID 169 | AGCAACCGGGTAGCGC | 204 | 219 | SEQ ID 509 | GCGCTACCCGGTTGCT | 0.35 |
| SEQ ID 170 | COMP ID 170 | CAGCAACCGGGTAGCG | 205 | 220 | SEQ ID 510 | CGCTACCCGGTTGCTG | 0.21 |
| SEQ ID 171 | COMP ID 171 | GCAGCAACCGGGTAGC | 206 | 221 | SEQ ID 511 | GCTACCCGGTTGCTGC | 0.19 |
| SEQ ID 172 | COMP ID 172 | AGCAGCAACCGGGTAG | 207 | 222 | SEQ ID 512 | CTACCCGGTTGCTGCT | 0.26 |
| SEQ ID 173 | COMP ID 173 | CAGCAGCAACCGGGTA | 208 | 223 | SEQ ID 513 | TACCCGGTTGCTGCTG | 0.22 |
| SEQ ID 174 | COMP ID 174 | GCAGCAGCAACCGGGT | 209 | 224 | SEQ ID 514 | ACCCGGTTGCTGCTGC | 0.42 |
| SEQ ID 175 | COMP ID 175 | GGCAGCAGCAACCGGG | 210 | 225 | SEQ ID 515 | CCCGGTTGCTGCTGCC | 0.41 |
| SEQ ID 176 | COMP ID 176 | GGGCAGCAGCAACCGG | 211 | 226 | SEQ ID 516 | CCGGTTGCTGCTGCCC | 0.44 |
| SEQ ID 177 | COMP ID 177 | TGGGCAGCAGCAACCG | 212 | 227 | SEQ ID 517 | CGGTTGCTGCTGCCCA | 0.42 |
| SEQ ID 178 | COMP ID 178 | TTGGGCAGCAGCAACC | 213 | 228 | SEQ ID 518 | GGTTGCTGCTGCCCAA | 0.36 |
| SEQ ID 179 | COMP ID 179 | CTTGGGCAGCAGCAAC | 214 | 229 | SEQ ID 519 | GTTGCTGCTGCCCAAG | 0.28 |
| SEQ ID 180 | COMP ID 180 | CCTTGGGCAGCAGCAA | 215 | 230 | SEQ ID 520 | TTGCTGCTGCCCAAGG | 0.31 |
| SEQ ID 181 | COMP ID 181 | TCCTTGGGCAGCAGCA | 216 | 231 | SEQ ID 521 | TGCTGCTGCCCAAGGA | 0.26 |
| SEQ ID 182 | COMP ID 182 | GTCCTTGGGCAGCAGC | 217 | 232 | SEQ ID 522 | GCTGCTGCCCAAGGAC | 0.60 |
| SEQ ID 183 | COMP ID 183 | GGTCCTTGGGCAGCAG | 218 | 233 | SEQ ID 523 | CTGCTGCCCAAGGACC | 0.39 |
| SEQ ID 184 | COMP ID 184 | CGGTCCTTGGGCAGCA | 219 | 234 | SEQ ID 524 | TGCTGCCCAAGGACCG | 0.30 |
| SEQ ID 185 | COMP ID 185 | GCGGTCCTTGGGCAGC | 220 | 235 | SEQ ID 525 | GCTGCCCAAGGACCGC | 0.44 |
| SEQ ID 186 | COMP ID 186 | CGCGGTCCTTGGGCAG | 221 | 236 | SEQ ID 526 | CTGCCCAAGGACCGCG | 0.21 |
| SEQ ID 187 | COMP ID 187 | CCGCGGTCCTTGGGCA | 222 | 237 | SEQ ID 527 | TGCCCAAGGACCGCGG | 0.25 |
| SEQ ID 188 | COMP ID 188 | TCCGCGGTCCTTGGGC | 223 | 238 | SEQ ID 528 | GCCCAAGGACCGCGGA | 0.21 |
| SEQ ID 189 | COMP ID 189 | CTCCGCGGTCCTTGGG | 224 | 239 | SEQ ID 529 | CCCAAGGACCGCGGAG | 0.25 |
| SEQ ID 190 | COMP ID 190 | ACTCCGCGGTCCTTGG | 225 | 240 | SEQ ID 530 | CCAAGGACCGCGGAGT | 0.55 |
| SEQ ID 191 | COMP ID 191 | GACTCCGCGGTCCTTG | 226 | 241 | SEQ ID 531 | CAAGGACCGCGGAGTC | 0.33 |
| SEQ ID 192 | COMP ID 192 | CGACTCCGCGGTCCTT | 227 | 242 | SEQ ID 532 | AAGGACCGCGGAGTCG | 0.49 |
| SEQ ID 193 | COMP ID 193 | CCGACTCCGCGGTCCT | 228 | 243 | SEQ ID 533 | AGGACCGCGGAGTCGG | 0.23 |
| SEQ ID 194 | COMP ID 194 | TCCGACTCCGCGGTCC | 229 | 244 | SEQ ID 534 | GGACCGCGGAGTCGGA | 0.20 |
| SEQ ID 195 | COMP ID 195 | GTCCGACTCCGCGGTC | 230 | 245 | SEQ ID 535 | GACCGCGGAGTCGGAC | 0.25 |
| SEQ ID 196 | COMP ID 196 | CGTCCGACTCCGCGGT | 231 | 246 | SEQ ID 536 | ACCGCGGAGTCGGACG | 0.55 |
| SEQ ID 197 | COMP ID 197 | GCGTCCGACTCCGCGG | 232 | 247 | SEQ ID 537 | CCGCGGAGTCGGACGC | 0.41 |
| SEQ ID 198 | COMP ID 198 | TGCGTCCGACTCCGCT | 233 | 248 | SEQ ID 538 | CGCGGAGTCGGACGCA | 0.33 |
| SEQ ID 199 | COMP ID 199 | CTGCGTCCGACTCCGC | 234 | 249 | SEQ ID 539 | GCGGAGTCGGACGCAG | 0,180.47 |

TABLE 1-continued

All the antisense oligonucleotides are designed as 16-mers DNA-LNA mixmers with a phosphorothioate backbone. LNA at the very 5' and 3' position and e.g. LNA for every $2^{nd}$ or $3^{rd}$ nucleotide (see Compound table).

| SEQ ID | Compound ID (See Compound Table) | Oligonucleotide Sequence Motif (nucleobase Sequence) | RefSeq NM_002087.3 (SEQ ID NO 1) Start Position | End Position | Target Site Sequence ID | Target Site Sequence | Relative luciferase activity (Relative to PBS) |
|---|---|---|---|---|---|---|---|
| SEQ ID 200 | COMP ID 200 | CCTGCGTCCGACTCCG | 235 | 250 | SEQ ID 540 | CGGAGTCGGACGCAGG | 0,140.60 |
| SEQ ID 201 | COMP ID 201 | GCCTGCGTCCGACTCC | 236 | 251 | SEQ ID 541 | GGAGTCGGACGCAGGC | 0,150.62 |
| SEQ ID 202 | COMP ID 202 | TGCCTGCGTCCGACTC | 237 | 252 | SEQ ID 542 | GAGTCGGACGCAGGCA | 0,230.65 |
| SEQ ID 203 | COMP ID 203 | CTGCCTGCGTCCGACT | 238 | 253 | SEQ ID 543 | AGTCGGACGCAGGCAG | 0,270.85 |
| SEQ ID 204 | COMP ID 204 | TCTGCCTGCGTCCGAC | 239 | 254 | SEQ ID 544 | GTCGGACGCAGGCAGA | 0,270.81 |
| SEQ ID 205 | COMP ID 205 | GTCTGCCTGCGTCCGA | 240 | 255 | SEQ ID 545 | TCGGACGCAGGCAGAC | 0,220.53 |
| SEQ ID 206 | COMP ID 206 | GGTCTGCCTGCGTCCG | 241 | 256 | SEQ ID 546 | CGGACGCAGGCAGACC | 0,330.80 |

Example 5

Antisense oligonucleotides were designed for the 5' UTR from position 119 to 158 according to RefSeq NM_002087.3 (SEQ ID NO 1) with one nucleotide basepair shift as shown in table 2, which also provides the data from the luciferase assay, were a value of greater than 1 indicates an increased expression of progranulin (i.e. progranulin agonist activity of the antisense oligonucleotide), and a value lower than 1 indicates a decreased expression of progranulin (i.e. an inhibition or antagonistic effect, on progranulin expression).

The results from example 4 and 5 show that antisense oligonucleotide agonism was identified for several compounds targeting the progranulin 5'UTR, particularly compounds with a contiguous nucleotide complementary to nucleotides 1-229 of SEQ ID NO 1, such as compounds complementary to SEQ ID NO 445, SEQ ID NO: 446, SEQ ID NO: 459, SEQ ID NO 465, SEQ ID NO 683, SEQ ID NO 568, SEQ ID NO 571, SEQ ID NO 575, SEQ ID NO 576, SEQ ID NO 577, SEQ ID NO 578, SEQ ID NO 584, & SEQ ID NO 586.

Compounds 105, 106, 119, 125, 117, 228, 231, 235-8, 244 and 246 were identified as having progranulin agonist activity in the luciferase assay.

TABLE 2

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every $2^{nd}$ or $3^{rd}$ nucleotide (see Compound table).

| SEQ ID | Compound ID number -See Compound Table | Oligonucleotide Sequence Motif (nucleobase Sequence) | RefSeq NM_002087.3 (SEQ ID NO 1) Start Position | End Position | Target Site Sequence ID | Target Site Sequence | Relative luciferase activity Relative to PBS |
|---|---|---|---|---|---|---|---|
| SEQ ID#207 | COMP ID 207 | GCTCCCATTGGCTACTTA | 119 | 136 | SEQ ID 547 | TAAGTAGCCAATGGGAGC | 0.32 |
| SEQ ID#208 | COMP ID 208 | CGCTCCCATTGGCTACTT | 120 | 137 | SEQ ID 548 | AAGTAGCCAATGGGAGCG | 0.22 |
| SEQ ID#209 | COMP ID 209 | CCGCTCCCATTGGCTACT | 121 | 138 | SEQ ID 549 | AGTAGCCAATGGGAGCGG | 0.19 |
| SEQ ID#210 | COMP ID 210 | CCCGCTCCCATTGGCTAC | 122 | 139 | SEQ ID 550 | GTAGCCAATGGGAGCGGG | 0.24 |
| SEQ ID#211 | COMP ID 211 | ACCCGCTCCCATTGGCTA | 123 | 140 | SEQ ID 551 | TAGCCAATGGGAGCGGGT | 0.37 |
| SEQ ID#212 | COMP ID 212 | TACCCGCTCCCATTGGCT | 124 | 141 | SEQ ID 552 | AGCCAATGGGAGCGGGTA | 0.38 |
| SEQ ID#213 | COMP ID 213 | CTACCCGCTCCCATTGGC | 125 | 142 | SEQ ID 553 | GCCAATGGGAGCGGGTAG | 0.39 |

TABLE 2-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID number -See Compound Table | Oligonucleotide Sequence Motif (nucleobase Sequence) | RefSeq NM_002087.3 (SEQ ID NO 1) Start Position | End Position | Target Site Sequence ID | Target Site Sequence | Relative luciferase activity Relative to PBS) |
|---|---|---|---|---|---|---|---|
| SEQ ID#214 | COMP ID 214 | GCTACCCGCTCCCATTGG | 126 | 143 | SEQ ID 554 | CCAATGGGAGCGGGTAGC | 0.47 |
| SEQ ID#215 | COMP ID 215 | GGCTACCCGCTCCCATTG | 127 | 144 | SEQ ID 555 | CAATGGGAGCGGGTAGCC | 0.55 |
| SEQ ID#216 | COMP ID 216 | GGGCTACCCGCTCCCATT | 128 | 145 | SEQ ID 556 | AATGGGAGCGGGTAGCCC | 0.53 |
| SEQ ID#217 | COMP ID 217 | AGGGCTACCCGCTCCCAT | 129 | 146 | SEQ ID 557 | ATGGGAGCGGGTAGCCCT | 0.56 |
| SEQ ID#218 | COMP ID 218 | CAGGGCTACCCGCTCCCA | 130 | 147 | SEQ ID 558 | TGGGAGCGGGTAGCCCTG | 0.49 |
| SEQ ID#219 | COMP ID 219 | TCAGGGCTACCCGCTCCC | 131 | 148 | SEQ ID 559 | GGGAGCGGGTAGCCCTGA | 0.58 |
| SEQ ID#220 | COMP ID 220 | ATCAGGGCTACCCGCTCC | 132 | 149 | SEQ ID 560 | GGAGCGGGTAGCCCTGAT | 0.48 |
| SEQ ID#221 | COMP ID 221 | GATCAGGGCTACCCGCTC | 133 | 150 | SEQ ID 561 | GAGCGGGTAGCCCTGATC | 0.49 |
| SEQ ID#222 | COMP ID 222 | GGATCAGGGCTACCCGCT | 134 | 151 | SEQ ID 562 | AGCGGGTAGCCCTGATCC | 0.38 |
| SEQ ID#223 | COMP ID 223 | GGGATCAGGGCTACCCGC | 135 | 152 | SEQ ID 563 | GCGGGTAGCCCTGATCCC | 0.33 |
| SEQ ID#224 | COMP ID 224 | AGGGATCAGGGCTACCCG | 136 | 153 | SEQ ID 564 | CGGGTAGCCCTGATCCCT | 0.36 |
| SEQ ID#225 | COMP ID 225 | CAGGGATCAGGGCTACCC | 137 | 154 | SEQ ID 565 | GGGTAGCCCTGATCCCTG | 0.48 |
| SEQ ID#226 | COMP ID 226 | CCAGGGATCAGGGCTACC | 138 | 155 | SEQ ID 566 | GGTAGCCCTGATCCCTGG | 0.69 |
| SEQ ID#227 | COMP ID 227 | GCCAGGGATCAGGGCTAC | 139 | 156 | SEQ ID 567 | GTAGCCCTGATCCCTGGC | 0.94 |
| SEQ ID#228 | COMP ID 228 | GGCCAGGGATCAGGGCTA | 140 | 157 | SEQ ID 568 | TAGCCCTGATCCCTGGCC | 1.15 |
| SEQ ID#229 | COMP ID 229 | TGGCCAGGGATCAGGGCT | 141 | 158 | SEQ ID 569 | AGCCCTGATCCCTGGCCA | 0.92 |
| SEQ ID#230 | COMP ID 230 | TTGGCCAGGGATCAGGGC | 142 | 159 | SEQ ID 570 | GCCCTGATCCCTGGCCAA | 0.85 |
| SEQ ID#231 | COMP ID 231 | ATTGGCCAGGGATCAGGG | 143 | 160 | SEQ ID 571 | CCCTGATCCCTGGCCAAT | 1.12 |
| SEQ ID#232 | COMP ID 232 | CATTGGCCAGGGATCAGG | 144 | 161 | SEQ ID 572 | CCTGATCCCTGGCCAATG | 0.72 |
| SEQ ID#233 | COMP ID 233 | CCATTGGCCAGGGATCAG | 145 | 162 | SEQ ID 573 | CTGATCCCTGGCCAATGG | 0.75 |
| SEQ ID#234 | COMP ID 234 | TCCATTGGCCAGGGATCA | 146 | 163 | SEQ ID 574 | TGATCCCTGGCCAATGGA | 0.97 |
| SEQ ID#235 | COMP ID 235 | TTCCATTGGCCAGGGATC | 147 | 164 | SEQ ID 575 | GATCCCTGGCCAATGGAA | 1.22 |
| SEQ ID#236 | COMP ID 236 | TTTCCATTGGCCAGGGAT | 148 | 165 | SEQ ID 576 | ATCCCTGGCCAATGGAAA | 1.13 |

TABLE 2-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID number -See Compound Table | Oligonucleotide Sequence Motif (nucleobase Sequence) | RefSeq NM_002087.3 (SEQ ID NO 1) Start Position | End Position | Target Site Sequence ID | Target Site Sequence | Relative luciferase activity Relative to PBS) |
|---|---|---|---|---|---|---|---|
| SEQ ID#237 | COMP ID 237 | GTTTCCATTGGCCAGGGA | 149 | 166 | SEQ ID 577 | TCCCTGGCCAATGGAAAC | 1.01 |
| SEQ ID#238 | COMP ID 238 | AGTTTCCATTGGCCAGGG | 150 | 167 | SEQ ID 578 | CCCTGGCCAATGGAAACT | 1.09 |
| SEQ ID#239 | COMP ID 239 | CAGTTTCCATTGGCCAGG | 151 | 168 | SEQ ID 579 | CCTGGCCAATGGAAACTG | 0.79 |
| SEQ ID#240 | COMP ID 240 | TCAGTTTCCATTGGCCAG | 152 | 169 | SEQ ID 580 | CTGGCCAATGGAAACTGA | 0.69 |
| SEQ ID#241 | COMP ID 241 | CTCAGTTTCCATTGGCCA | 153 | 170 | SEQ ID 581 | TGGCCAATGGAAACTGAG | 0.59 |
| SEQ ID#242 | COMP ID 242 | CCTCAGTTTCCATTGGCC | 154 | 171 | SEQ ID 582 | GGCCAATGGAAACTGAGG | 0.39 |
| SEQ ID#243 | COMP ID 243 | ACCTCAGTTTCCATTGGC | 155 | 172 | SEQ ID 583 | GCCAATGGAAACTGAGGT | 0.95 |
| SEQ ID#244 | COMP ID 244 | TACCTCAGTTTCCATTGG | 156 | 173 | SEQ ID 584 | CCAATGGAAACTGAGGTA | 1.12 |
| SEQ ID#245 | COMP ID 245 | CTACCTCAGTTTCCATTG | 157 | 174 | SEQ ID 585 | CAATGGAAACTGAGGTAG | 1.00 |
| SEQ ID#246 | COMP ID 246 | CCTACCTCAGTTTCCATT | 158 | 175 | SEQ ID 586 | AATGGAAACTGAGGTAGG | 1.26 |

Example 6

Antisense oligonucleotides were designed for the 3' UTR from position 2044 to 2346 according to RefSeq NM_002807.3 with three nucleotide basepair shift as shown in table 3 which also provides the data from the luciferase assay, were a value of greater than 1 indicates an increased expression of progranulin (i.e. progranulin agonist activity of the antisense oligonucleotide), and a value lower than 1 indicates a decreased expression of progranulin (i.e. an inhibition or antagonistic effect, on progranulin expression).

The data shows antisense oligonucleotide antisense oligonucleotides with progranulin agonist activity that are complementary to the 3'UTR region of a human progranulin mRNA transcript were identified, for example compounds with a contiguous nucleotide sequence which is complementary to a sequence selected from the group consisting of SEQ ID NO 684, 685, 683, 686, 687, and 688, such as compounds with a contiguous nucleotide sequence which is complementary to a sequence selected from the group consisting of 607, 608, 609, 610, 611, 612, 619, 620, 633, 640, 641, 645, 651, and 652.

Compounds 263, 267, 269-272, 279, 280, 293, 300, 301, 305, 311, 312 and 327 were identified as exhibiting progranulin agonist activity in the luciferase assay system used.

TABLE 3

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID # (see Compound | Oligonucleotide Sequence Motif (nucleobase Sequence) | RefSeq NM_002087.3 (SEQ ID NO 1) Start Position | End Position | Sequence ID | Target Site Sequence | Relative luciferase activity Relative to PBS) |
|---|---|---|---|---|---|---|---|
| SEQ ID #247 | COMP ID 247 | 5'-TGCAGAGTCTTCAGTACT-3' | 2044 | 2061 | SEQ ID 587 | AGTACTGAAGACTCTGCA | 0.46 |
| SEQ ID #248 | COMP ID 248 | 5'-GGCTGCAGAGTCTTCAGT-3' | 2047 | 2064 | SEQ ID 588 | ACTGAAGACTCTGCAGCC | 0.25 |

TABLE 3-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID # (see Compound Sequence Motif (nucleobase Sequence) | Oligonucleotide | RefSeq NM_002087.3 (SEQ ID NO 1) Start Position | End Position | Target Site Sequence ID | Target Site Sequence | Relative luciferase activity Relative to PBS) |
|---|---|---|---|---|---|---|---|
| SEQ ID #249 | COMP ID 249 | 5'-GAGGGCTGCAGAGTCTTC-3' | 2050 | 2067 | SEQ ID 589 | GAAGACTCTGCAGCCCTC | 0.35 |
| SEQ ID #250 | COMP ID 250 | 5'-CCCGAGGGCTGCAGAGTC-3' | 2053 | 2070 | SEQ ID 590 | GACTCTGCAGCCCTCGGG | 0.65 |
| SEQ ID #251 | COMP ID 251 | 5'-GGTCCCGAGGGCTGCAGA-3' | 2056 | 2073 | SEQ ID 591 | TCTGCAGCCCTCGGGACC | 0.69 |
| SEQ ID #252 | COMP ID 252 | 5'-TGGGGTCCCGAGGGCTGC-3' | 2059 | 2076 | SEQ ID 592 | GCAGCCCTCGGGACCCCA | 0.37 |
| SEQ ID #253 | COMP ID 253 | 5'-GAGTGGGGTCCCGAGGGC-3' | 2062 | 2079 | SEQ ID 593 | GCCCTCGGGACCCCACTC | 0.77 |
| SEQ ID #254 | COMP ID 254 | 5'-TCCGAGTGGGGTCCCGAG-3' | 2065 | 2082 | SEQ ID 594 | CTCGGGACCCCACTCGGA | 0.75 |
| SEQ ID #255 | COMP ID 255 | 5'-CCCTCCGAGTGGGGTCCC-3' | 2068 | 2085 | SEQ ID 595 | GGGACCCCACTCGGAGGG | 0.67 |
| SEQ ID #256 | COMP ID 256 | 5'-GCACCCTCCGAGTGGGGT-3' | 2071 | 2088 | SEQ ID 596 | ACCCCACTCGGAGGGTGC | 0.57 |
| SEQ ID #257 | COMP ID 257 | 5'-AGGGCACCCTCCGAGTGG-3' | 2074 | 2091 | SEQ ID 597 | CCACTCGGAGGGTGCCCT | 0.78 |
| SEQ ID #258 | COMP ID 258 | 5'-CAGAGGGCACCCTCCGAG-3' | 2077 | 2094 | SEQ ID 598 | CTCGGAGGGTGCCCTCTG | 0.92 |
| SEQ ID #259 | COMP ID 259 | 5'-GAGCAGAGGGCACCCTCC-3' | 2080 | 2097 | SEQ ID 599 | GGAGGGTGCCCTCTGCTC | 0.29 |
| SEQ ID #260 | COMP ID 260 | 5'-CCTGAGCAGAGGGCACCC-3' | 2083 | 2100 | SEQ ID 600 | GGGTGCCCTCTGCTCAGG | 0.63 |
| SEQ ID #261 | COMP ID 261 | 5'-AGGCCTGAGCAGAGGGCA-3' | 2086 | 2103 | SEQ ID 601 | TGCCCTCTGCTCAGGCCT | 0.56 |
| SEQ ID #262 | COMP ID 262 | 5'-GGGAGGCCTGAGCAGAGG-3' | 2089 | 2106 | SEQ ID 602 | CCTCTGCTCAGGCCTCCC | 0.74 |
| SEQ ID #263 | COMP ID 263 | 5'-CTAGGGAGGCCTGAGCAG-3' | 2092 | 2109 | SEQ ID 603 | CTGCTCAGGCCTCCCTAG | 1.13 |
| SEQ ID #264 | COMP ID 264 | 5'-GTGCTAGGGAGGCCTGAG-3' | 2095 | 2112 | SEQ ID 604 | CTCAGGCCTCCCTAGCAC | 0.99 |
| SEQ ID #265 | COMP ID 265 | 5'-GAGGTGCTAGGGAGGCCT-3' | 2098 | 2115 | SEQ ID 605 | AGGCCTCCCTAGCACCTC | 0.83 |
| SEQ ID #266 | COMP ID 266 | 5'-GGGGAGGTGCTAGGGAGG-3' | 2101 | 2118 | SEQ ID 606 | CCTCCCTAGCACCTCCCC | 0.89 |
| SEQ ID #267 | COMP ID 267 | 5'-TAGGGGAGGTGCTAGGG-3' | 2104 | 2121 | SEQ ID 607 | CCCTAGCACCTCCCCCTA | 1.27 |
| SEQ ID #268 | COMP ID 268 | 5'-GGTTAGGGGAGGTGCTA-3' | 2107 | 2124 | SEQ ID 608 | TAGCACCTCCCCCTAACC | 0.58 |
| SEQ ID #269 | COMP ID 269 | 5'-TTTGGTTAGGGGAGGTG-3' | 2110 | 2127 | SEQ ID 609 | CACCTCCCCCTAACCAAA | 1.09 |
| SEQ ID #270 | COMP ID 270 | 5'-GAATTTGGTTAGGGGAG-3' | 2113 | 2130 | SEQ ID 610 | CTCCCCCTAACCAAATTC | 1.24 |
| SEQ ID #271 | COMP ID 271 | 5'-GGAGAATTTGGTTAGGGG-3' | 2116 | 2133 | SEQ ID 611 | CCCCTAACCAAATTCTCC | 1.05 |

TABLE 3-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID # (see Compound) | Oligonucleotide Sequence Motif (nucleobase Sequence) | RefSeq NM_002087.3 (SEQ ID NO 1) Start Position | End Position | Target Site Sequence ID | Target Site Sequence | Relative luciferase activity Relative to PBS) |
|---|---|---|---|---|---|---|---|
| SEQ ID #272 | COMP ID 272 | 5'-CAGGGAGAATTTGGTTAG-3' | 2119 | 2136 | SEQ ID 612 | CTAACCAAATTCTCCCTG | 1.04 |
| SEQ ID #273 | COMP ID 273 | 5'-GTCCAGGGAGAATTTGGT-3' | 2122 | 2139 | SEQ ID 613 | ACCAAATTCTCCCTGGAC | 0.94 |
| SEQ ID #274 | COMP ID 274 | 5'-GGGGTCCAGGGAGAATTT-3' | 2125 | 2142 | SEQ ID 614 | AAATTCTCCCTGGACCCC | 0.89 |
| SEQ ID #275 | COMP ID 275 | 5'-AATGGGGTCCAGGGAGAA-3' | 2128 | 2145 | SEQ ID 615 | TTCTCCCTGGACCCCATT | 0.99 |
| SEQ ID #276 | COMP ID 276 | 5'-CAGAATGGGGTCCAGGGA-3' | 2131 | 2148 | SEQ ID 616 | TCCCTGGACCCCATTCTG | 0.60 |
| SEQ ID #277 | COMP ID 277 | 5'-GCTCAGAATGGGGTCCAG-3' | 2134 | 2151 | SEQ ID 617 | CTGGACCCCATTCTGAGC | 0.52 |
| SEQ ID #278 | COMP ID 278 | 5'-GGAGCTCAGAATGGGGTC-3' | 2137 | 2154 | SEQ ID 618 | GACCCCATTCTGAGCTCC | 0.91 |
| SEQ ID #279 | COMP ID 279 | 5'-TGGGGAGCTCAGAATGGG-3' | 2140 | 2157 | SEQ ID 619 | CCCATTCTGAGCTCCCCA | 1.14 |
| SEQ ID #280 | COMP ID 280 | 5'-TGATGGGGAGCTCAGAAT-3' | 2143 | 2160 | SEQ ID 620 | ATTCTGAGCTCCCCATCA | 1.11 |
| SEQ ID #281 | COMP ID 281 | 5'-TGGTGATGGGGAGCTCAG-3' | 2156 | 2163 | SEQ ID 621 | CTGAGCTCCCCATCACCA | 0.97 |
| SEQ ID #282 | COMP ID 282 | 5'-CCATGGTGATGGGGAGCT-3' | 2149 | 2166 | SEQ ID 622 | AGCTCCCCATCACCATGG | 0.97 |
| SEQ ID #283 | COMP ID 283 | 5'-CTCCCATGGTGATGGGGA-3' | 2152 | 2169 | SEQ ID 623 | TCCCCATCACCATGGGAG | 0.81 |
| SEQ ID #284 | COMP ID 284 | 5'-CACCTCCCATGGTGATGG-3' | 2155 | 2172 | SEQ ID 624 | CCATCACCATGGGAGGTG | 0.69 |
| SEQ ID #285 | COMP ID 285 | 5'-CCCCACCTCCCATGGTGA-3' | 2158 | 2175 | SEQ ID 625 | TCACCATGGGAGGTGGGG | 0.69 |
| SEQ ID #286 | COMP ID 286 | 5'-AGGCCCCACCTCCCATGG-3' | 2161 | 2178 | SEQ ID 626 | CCATGGGAGGTGGGGCCT | 0.58 |
| SEQ ID #287 | COMP ID 287 | 5'-TTGAGGCCCCACCTCCCA-3' | 2164 | 2181 | SEQ ID 627 | TGGGAGGTGGGGCCTCAA | 0.47 |
| SEQ ID #288 | COMP ID 288 | 5'-AGATTGAGGCCCCACCTC-3' | 2167 | 2184 | SEQ ID 628 | GAGGTGGGGCCTCAATCT | 0.59 |
| SEQ ID #289 | COMP ID 289 | 5'-CTTAGATTGAGGCCCCAC-3' | 2170 | 2187 | SEQ ID 629 | GTGGGGCCTCAATCTAAG | 0.38 |
| SEQ ID #290 | COMP ID 290 | 5'-GGCCTTAGATTGAGGCCC-3' | 2173 | 2190 | SEQ ID 630 | GGGCCTCAATCTAAGGCC | 0.43 |
| SEQ ID #291 | COMP ID 291 | 5'-GAAGGCCTTAGATTGAGG-3' | 2176 | 2193 | SEQ ID 631 | CCTCAATCTAAGGCCTTC | 0.76 |
| SEQ ID #292 | COMP ID 292 | 5'-AGGGAAGGCCTTAGATTG-3' | 2179 | 2196 | SEQ ID 632 | CAATCTAAGGCCTTCCCT | 0.86 |
| SEQ ID #293 | COMP ID 293 | 5'-GACAGGGAAGGCCTTAGA-3' | 2182 | 2199 | SEQ ID 633 | TCTAAGGCCTTCCCTGTC | 1.04 |
| SEQ ID #294 | COMP ID 294 | 5'-TCTGACAGGGAAGGCCTT-3' | 2185 | 2202 | SEQ ID 634 | AAGGCCTTCCCTGTCAGA | 0.81 |

TABLE 3-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID # (see Compound Sequence Motif (nucleobase Sequence)) | Oligonucleotide | RefSeq NM_002087.3 (SEQ ID NO 1) Start Position | End Position | Target Site Sequence ID | Target Site Sequence | Relative luciferase activity Relative to PBS) |
|---|---|---|---|---|---|---|---|
| SEQ ID #295 | COMP ID 295 | 5'-CCTTCTGACAGGGAAGGC-3' | 2188 | 2205 | SEQ ID 635 | GCCTTCCCTGTCAGAAGG | 0.89 |
| SEQ ID #296 | COMP ID 296 | 5'-CCCCCTTCTGACAGGGAA-3' | 2191 | 2208 | SEQ ID 636 | TTCCCTGTCAGAAGGGGG | 0.71 |
| SEQ ID #297 | COMP ID 297 | 5'-CAACCCCTTCTGACAGG-3' | 2194 | 2211 | SEQ ID 637 | CCTGTCAGAAGGGGTTG | 0.89 |
| SEQ ID #298 | COMP ID 298 | 5'-CCACAACCCCTTCTGAC-3' | 2197 | 2214 | SEQ ID 638 | GTCAGAAGGGGTTGTGG | 0.42 |
| SEQ ID #299 | COMP ID 299 | 5'-TTGCCACAACCCCTTCT-3' | 2200 | 2217 | SEQ ID 639 | AGAAGGGGTTGTGGCAA | 0.88 |
| SEQ ID #300 | COMP ID 300 | 5'-CTTTTGCCACAACCCCT-3' | 2203 | 2220 | SEQ ID 640 | AGGGGGTTGTGGCAAAAG | 1.16 |
| SEQ ID #301 | COMP ID 301 | 5'-TGGCTTTTGCCACAACCC-3' | 2206 | 2223 | SEQ ID 641 | GGGTTGTGGCAAAAGCCA | 1.08 |
| SEQ ID #302 | COMP ID 302 | 5'-ATGTGGCTTTTGCCACAA-3' | 2209 | 2226 | SEQ ID 642 | TTGTGGCAAAAGCCACAT | 1.01 |
| SEQ ID #303 | COMP ID 303 | 5'-GTAATGTGGCTTTTGCCA-3' | 2212 | 2229 | SEQ ID 643 | TGGCAAAAGCCACATTAC | 0.55 |
| SEQ ID #304 | COMP ID 304 | 5'-CTTGTAATGTGGCTTTTG-3' | 2215 | 2232 | SEQ ID 644 | CAAAAGCCACATTACAAG | 1.01 |
| SEQ ID #305 | COMP ID 305 | 5'-CAGCTTGTAATGTGGCTT-3' | 2218 | 2235 | SEQ ID 645 | AAGCCACATTACAAGCTG | 1.50 |
| SEQ ID #306 | COMP ID 306 | 5'-TGGCAGCTTGTAATGTGG-3' | 2221 | 2238 | SEQ ID 646 | CCACATTACAAGCTGCCA | 0.96 |
| SEQ ID #307 | COMP ID 307 | 5'-GGATGGCAGCTTGTAATG-3' | 2224 | 2241 | SEQ ID 647 | CATTACAAGCTGCCATCC | 0.74 |
| SEQ ID #308 | COMP ID 308 | 5'-AGGGGATGGCAGCTTGTA-3' | 2227 | 2244 | SEQ ID 648 | TACAAGCTGCCATCCCCT | 0.84 |
| SEQ ID #309 | COMP ID 309 | 5'-GGGAGGGGATGGCAGCTT-3' | 2230 | 2247 | SEQ ID 649 | AAGCTGCCATCCCCTCCC | 0.63 |
| SEQ ID #310 | COMP ID 310 | 5'-ACGGGGAGGGGATGGCAG-3' | 2233 | 2250 | SEQ ID 650 | CTGCCATCCCCTCCCCGT | 0.71 |
| SEQ ID #311 | COMP ID 311 | 5'-GAAACGGGGAGGGGATGG-3' | 2236 | 2253 | SEQ ID 651 | CCATCCCCTCCCCGTTTC | 1.06 |
| SEQ ID #312 | COMP ID 312 | 5'-ACTGAAACGGGGAGGGGA-3' | 2239 | 2256 | SEQ ID 652 | TCCCCTCCCCGTTTCAGT | 1.08 |
| SEQ ID #313 | COMP ID 313 | 5'-TCCACTGAAACGGGGAGG-3' | 2242 | 2259 | SEQ ID 653 | CCTCCCCGTTTCAGTGGA | 0.53 |
| SEQ ID #314 | COMP ID 314 | 5'-GGGTCCACTGAAACGGGG-3' | 2245 | 2262 | SEQ ID 654 | CCCCGTTTCAGTGGACCC | 0.93 |
| SEQ ID #315 | COMP ID 315 | 5'-ACAGGGTCCACTGAAACG-3' | 2248 | 2265 | SEQ ID 655 | CGTTTCAGTGGACCCTGT | 0.49 |
| SEQ ID #316 | COMP ID 316 | 5'-GCCACAGGGTCCACTGAA-3' | 2251 | 2268 | SEQ ID 656 | TTCAGTGGACCCTGTGGC | 0.57 |
| SEQ ID #317 | COMP ID 317 | 5'-CTGGCCACAGGGTCCACT-3' | 2254 | 2271 | SEQ ID 657 | AGTGGACCCTGTGGCCAG | 0.51 |

TABLE 3-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID # (see Compound) | Oligonucleotide Sequence Motif (nucleobase Sequence) | RefSeq NM_002087.3 (SEQ ID NO 1) Start Position | Target Site End Position | Sequence ID | Target Site Sequence | Relative luciferase activity Relative to PBS) |
|---|---|---|---|---|---|---|---|
| SEQ ID #318 | COMP ID 318 | 5'-CACCTGGCCACAGGGTCC-3' | 2257 | 2274 | SEQ ID 658 | GGACCCTGTGGCCAGGTG | 0.73 |
| SEQ ID #319 | COMP ID 319 | 5'-AAGCACCTGGCCACAGGG-3' | 2260 | 2277 | SEQ ID 659 | CCCTGTGGCCAGGTGCTT | 0.43 |
| SEQ ID #320 | COMP ID 320 | 5'-GAAAAGCACCTGGCCACA-3' | 2263 | 2280 | SEQ ID 660 | TGTGGCCAGGTGCTTTTC | 0.33 |
| SEQ ID #321 | COMP ID 321 | 5'-AGGGAAAAGCACCTGGCC-3' | 2266 | 2283 | SEQ ID 661 | GGCCAGGTGCTTTTCCCT | 0.16 |
| SEQ ID #322 | COMP ID 322 | 5'-GATAGGGAAAAGCACCTG-3' | 2269 | 2286 | SEQ ID 662 | CAGGTGCTTTTCCCTATC | 0.65 |
| SEQ ID #323 | COMP ID 323 | 5'-GTGGATAGGGAAAAGCAC-3' | 2272 | 2289 | SEQ ID 663 | GTGCTTTTCCCTATCCAC | 0.54 |
| SEQ ID #324 | COMP ID 324 | 5'-CCTGTGGATAGGGAAAAG-3' | 2275 | 2292 | SEQ ID 664 | CTTTTCCCTATCCACAGG | 0.63 |
| SEQ ID #325 | COMP ID 325 | 5'-ACCCCTGTGGATAGGGAA-3' | 2278 | 2295 | SEQ ID 665 | TTCCCTATCCACAGGGGT | 0.29 |
| SEQ ID #326 | COMP ID 326 | 5'-AACACCCCTGTGGATAGG-3' | 2281 | 2298 | SEQ ID 666 | CCTATCCACAGGGGTGTT | 0.62 |
| SEQ ID #327 | COMP ID 327 | 5'-ACAAACACCCCTGTGGAT-3' | 2284 | 2301 | SEQ ID 667 | ATCCACAGGGGTGTTTGT | 1.08 |
| SEQ ID #328 | COMP ID 328 | 5'-CACACAAACACCCCTGTG-3' | 2287 | 2304 | SEQ ID 668 | CACAGGGGTGTTTGTGTG | 0.81 |
| SEQ ID #329 | COMP ID 329 | 5'-ACACACACAAACACCCCT-3' | 2290 | 2307 | SEQ ID 669 | AGGGGTGTTTGTGTGTGT | 0.88 |
| SEQ ID #330 | COMP ID 330 | 5'-CGCACACACACAAACACC-3' | 2293 | 2310 | SEQ ID 670 | GGTGTTTGTGTGTGTGCG | 0.60 |
| SEQ ID #331 | COMP ID 331 | 5'-ACGCGCACACACACAAAC-3' | 2296 | 2313 | SEQ ID 671 | GTTTGTGTGTGTGCGCGT | 0.68 |
| SEQ ID #332 | COMP ID 332 | 5'-CACACGCGCACACACACA-3' | 2299 | 2316 | SEQ ID 672 | TGTGTGTGTGCGCGTGTG | 0.51 |
| SEQ ID #333 | COMP ID 333 | 5'-ACGCACACGCGCACACAC-3' | 2302 | 2319 | SEQ ID 673 | GTGTGTGCGCGTGTGCGT | 0.25 |
| SEQ ID #334 | COMP ID 334 | 5'-GAAACGCACACGCGCACA-3' | 2305 | 2322 | SEQ ID 674 | TGTGCGCGTGTGCGTTTC | 0.66 |
| SEQ ID #335 | COMP ID 335 | 5'-ATTGAAACGCACACGCGC-3' | 2308 | 2325 | SEQ ID 675 | GCGCGTGTGCGTTTCAAT | 0.82 |
| SEQ ID #336 | COMP ID 336 | 5'-TTTATTGAAACGCACACG-3' | 2311 | 2328 | SEQ ID 676 | CGTGTGCGTTTCAATAAA | 0.76 |
| SEQ ID #337 | COMP ID 337 | 5'-AACTTTATTGAAACGCAC-3' | 2314 | 2331 | SEQ ID 677 | GTGCGTTTCAATAAAGTT | 0.73 |
| SEQ ID #338 | COMP ID 338 | 5'-ACAAACTTTATTGAAACG-3' | 2317 | 2334 | SEQ ID 678 | CGTTTCAATAAAGTTTGT | 0.84 |
| SEQ ID #339 | COMP ID 339 | 5'-TGTACAAACTTTATTGAA-3' | 2320 | 2337 | SEQ ID 679 | TTCAATAAAGTTTGTACA | 0.98 |
| SEQ ID #340 | COMP ID 340 | 5'-AAGTGTACAAACTTTATT-3' | 2323 | 2340 | SEQ ID 680 | AATAAAGTTTGTACACTT | 0.87 |

TABLE 3-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every $2^{nd}$ or $3^{rd}$ nucleotide (see Compound table).

| SEQ ID | Compound ID # (see Compound | Oligonucleotide Sequence Motif (nucleobase Sequence) | RefSeq NM_002087.3 (SEQ ID NO 1) Start Position | End Position | Target Site Sequence ID | Target Site Sequence | Relative luciferase activity Relative to PBS) |
|---|---|---|---|---|---|---|---|
| SEQ ID #341 | COMP ID 341 | 5'-AGAAAGTGTACAAACTTT-3' | 2326 | 2343 | SEQ ID 681 | AAAGTTTGTACACTTTCT | 0.72 |
| SEQ ID #342 | COMP ID 342 | 5'-TTAAGAAAGTGTACAAAC-3' | 2329 | 2346 | SEQ ID 682 | GTTTGTACACTTTCTTAA | 0.87 |

Example 7: 16-Mer Oligos Targeting the 5' UTR 16-mer Oligos targeting 5' UTR uORF region (SEQ ID Nos 95-136) were selected, prepared and profiled for effects on Progranulin protein expression.

H4 neuroglioma cells were seeded in 96 well plates 5000 pr well, and treated with 10 µM final concentration of compounds for 5 days in 200 µL medium.

Microglia cells were chosen for analysis because these cells produce high levels of progranulin. Reduction of progranulin in microglia cells alone is sufficient to effect inflammation, lysosomal dysfunction, and hyperproliferation in a cell-autonomous manner. Therefore, targeting microglial dysfunction caused by progranulin insufficiency represents a potential therapeutic strategy to manage neurodegeneration in Frontotemporal dementia. To study effects on Progranulin in cellular systems, H4 cells (ATCC HTB-148) a commercial available glial cell line derived from a cancer patient have been used for identifying oligonucleotides capable of increasing progranulin production.

To further use Microglia that exhibit functional characteristics similar to human microglia, including phagocytosis and cytokine-mediated inflammatory responses, and express relevant microglial markers, hiPSC derived microglia iCell® Microglia from FujiFilm Cellular Dynamics Inc. (Cat. no R1131) have been used for investigating effects of selected oligonucleotides on progranulin production.

Progranulin expression levels were evaluated in media after dilution 1:8 by ELISA from Abcam (ab252364). Compound #105, #106, #110, #113 and #114 induced progranulin secretion more than 150% compared to PBS as shown in FIG. 1.

Compounds #105, #106, #110 and #114 localise on the 5' UTR of Proganulin transcript, targeting the uORF region as shown in FIG. 2.

H4 cells were seeded in 96 well plates 5000 pr well, and treated with 10 µM final concentration of compounds for 5 days in 200 µL medium. Progranulin expression levels were evaluated in cell lysate (RIPA lysis and extraction buffer from Pierce cat. No. 89900) using the WES platform (ProteinSimple) and GRN antibody Invitrogen PA5-27275 diluted 1:25 and HPRT1 antibody ab109021 (Abcam) diluted 1:50. GRN expression was normalized to endogenous housekeeping protein HPRT1.

Figure 3:
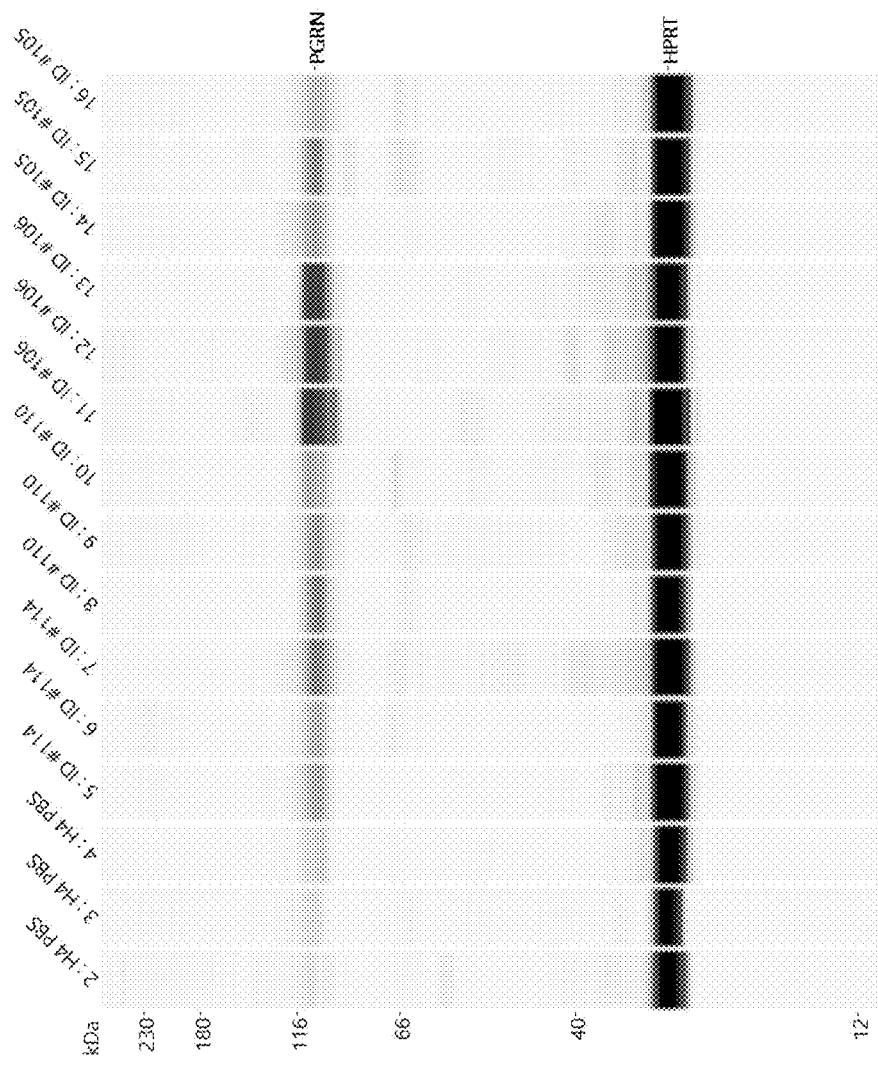
FIGS. 3 and 4 show progranulin expression levels in H4 neuroglioma cells following 5 days of treatment with 16-mer oligos targeting 5' UTR uORF region. Progranulin expression levels were evaluated in cell lysate (RIPA lysis and extraction buffer from Pierce cat. No. 89900) using the WES platform (ProteinSimple) and GRN antibody Invitrogen PA5-27275 diluted 1:25 and HPRT1 antibody ab109021 (Abcam) diluted 1:50.
Figure 4:
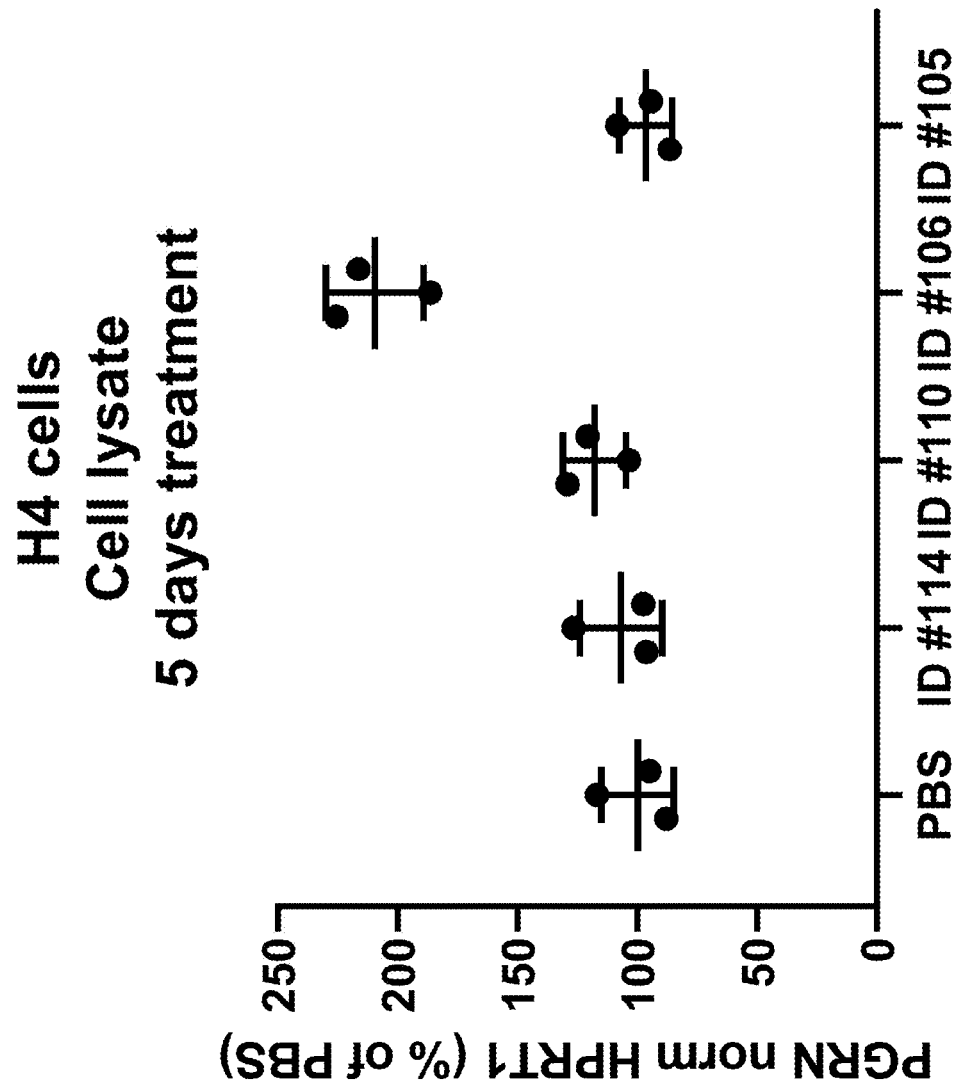

Compounds #106, #110, and #114 induced Progranulin in cell lysate compared to PBS as shown in FIGS. 3 and 4.

Example 8: Compound #106 hiPSC derived microglia (iCell Microglia Kit, 01279, Cat. no R1131) were seeded in 48 well plates with 100000 pr well in 500 µL, and were treated with varying concentrations of Compound #106 for 5 days.

Progranulin expression levels were evaluated in media after dilution 1:8 by ELISA from Abcam (ab252364).

Figure 5:
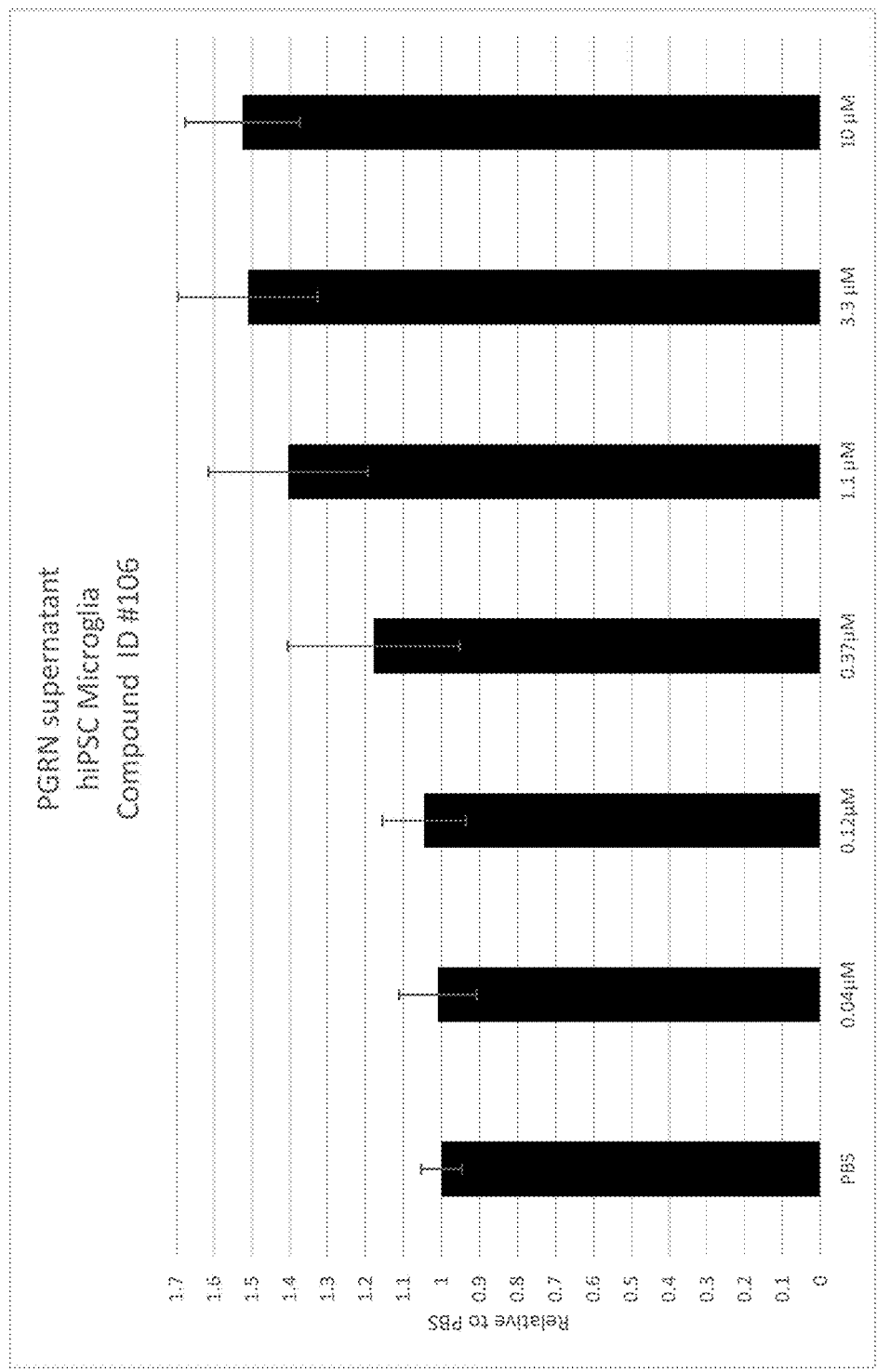
FIG. 5 shows the level of progranulin expression in hiPSC derived microglia following 5 days of treatment with Compound #106. Progranulin expression levels were evaluated in media after dilution 1:8 by ELISA from Abcam (ab252364).

Compound #106 (n=3) dose-dependently induced Progranulin secretion compared to PBS as shown in FIG. 5.

Example 9: 18-Mer Oligos Targeting 5' UTR 18-mer Oligos targeting 5' UTR uORF region (SEQ ID NOs: 207-245) were selected, prepared and profiled for effects on Progranulin protein expression.

H4 neuroglioma cells were seeded in 96 well plates 5000 pr well and treated with 10 µM final concentration of compounds for 5 days in 200 µL medium. Progranulin expression levels were evaluated in media after dilution 1:8 by ELISA from Abcam (ab252364).

Figure 6:
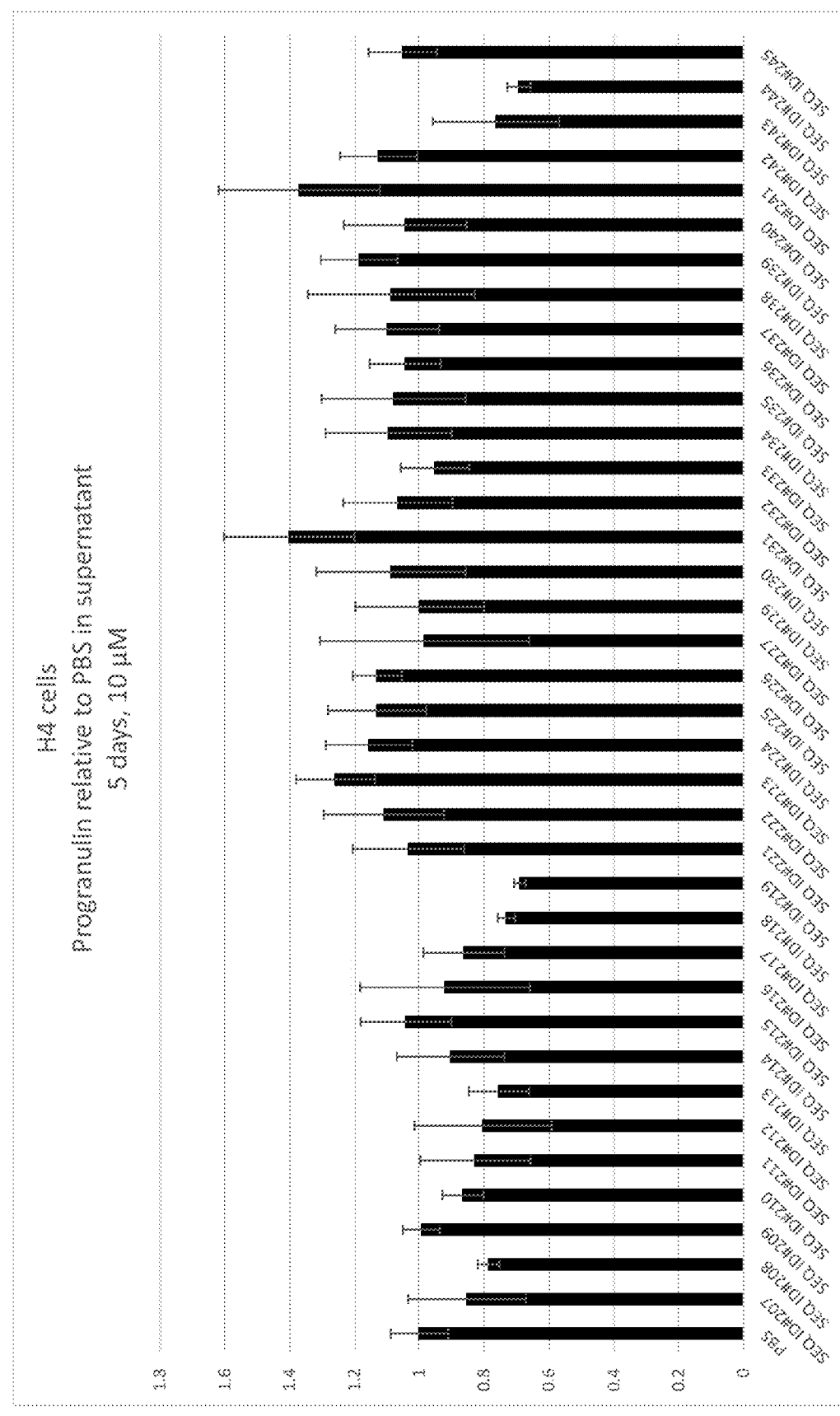
FIG. 6 shows progranulin expression levels in H4 neuroglioma cells following 5 days of treatment with 18-mer oligos targeting the progranulin 5' UTR uORF region. Progranulin expression levels were evaluated in media after dilution 1:8 by ELISA from Abcam (ab252364).

Compound #231 and #241 induced Progranulin secretion compared to PBS as shown in FIG. 6.

Example 10: Compound #106

Figure 7:
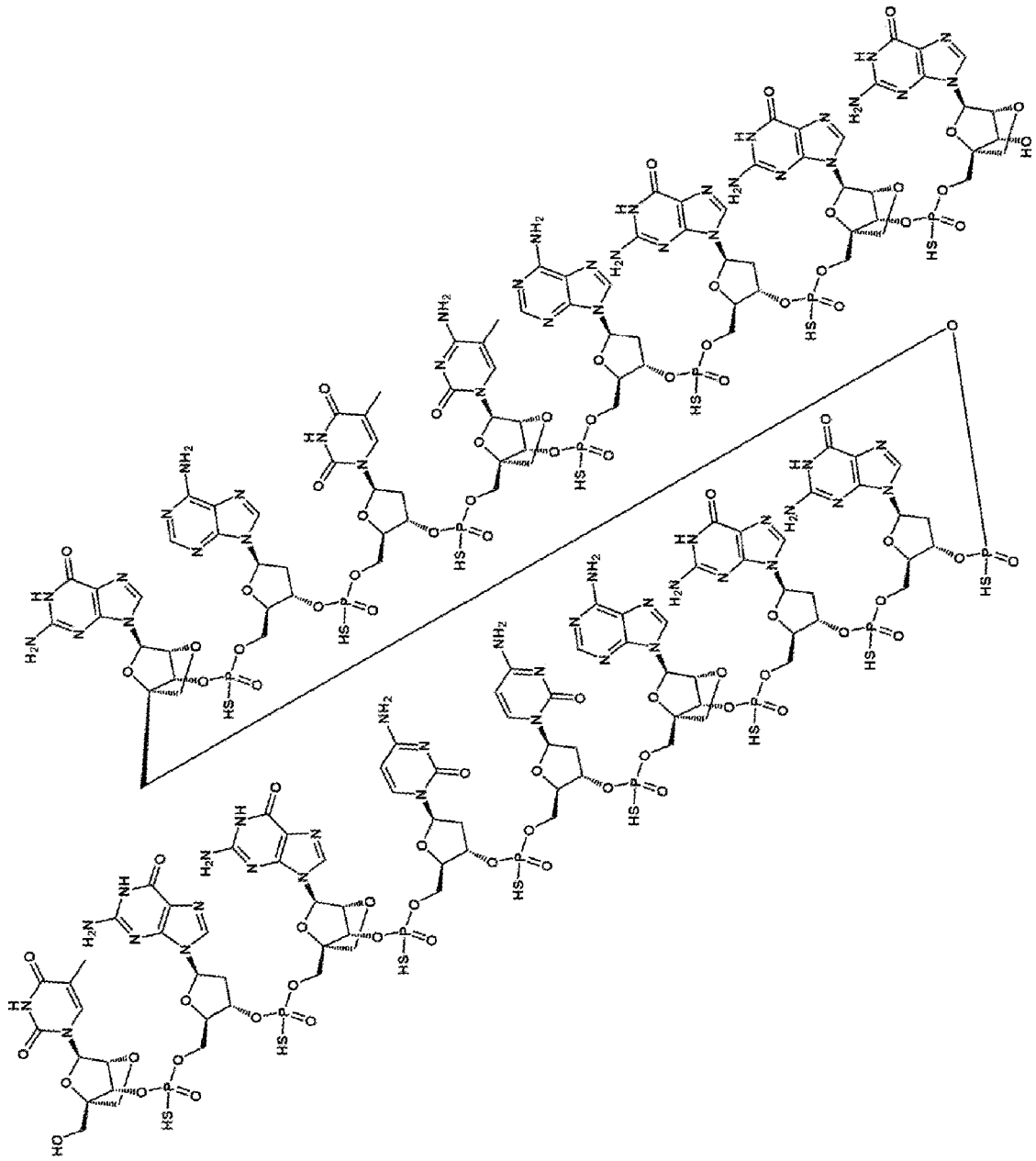
FIG. 7 shows the structure of Compound ID #106 (SEQ ID NO 106).
Figure 8:
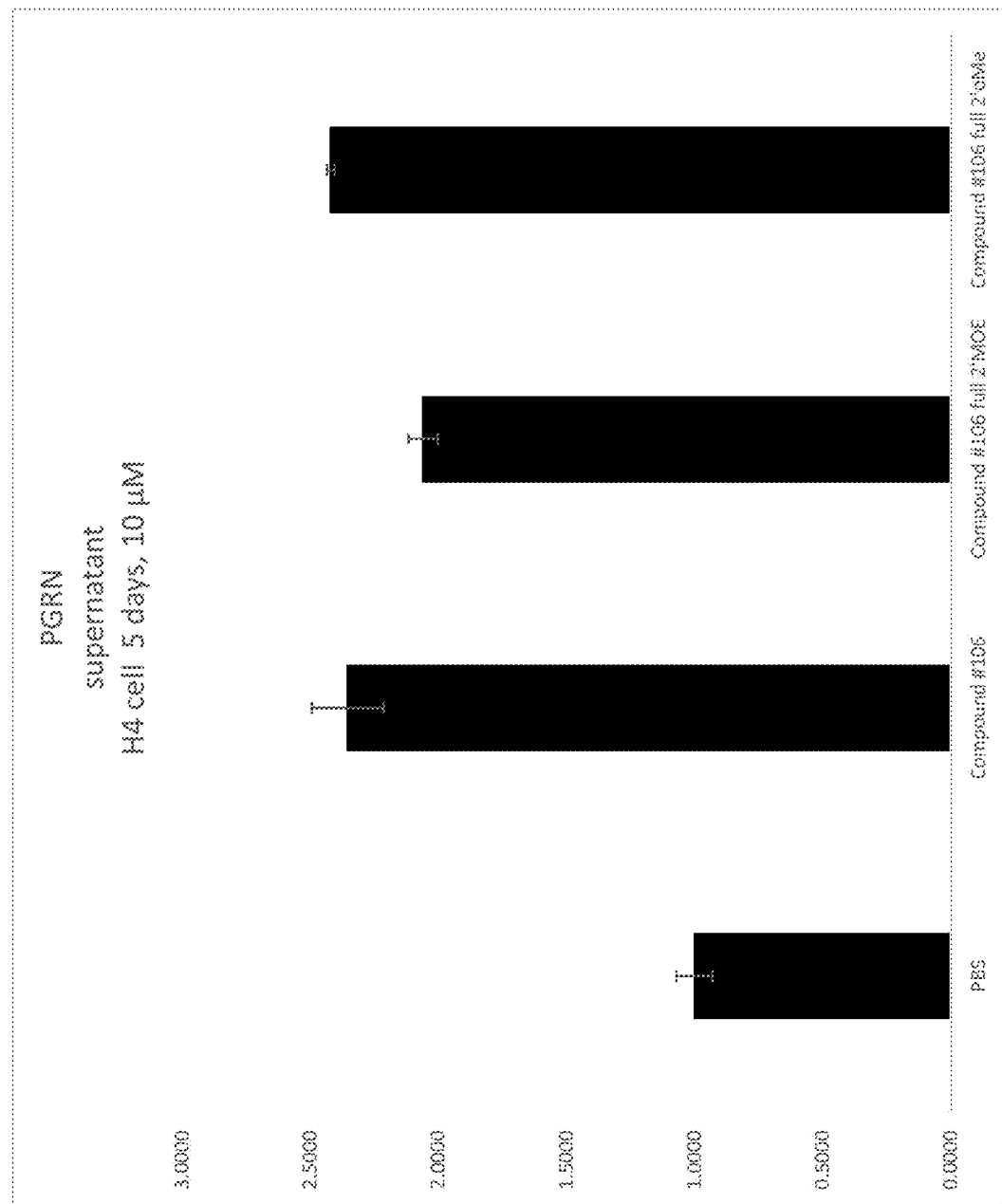
FIG. 8 shows progranulin expression in H4 neuroglioma cells following treatment with Compound #106, Compound #106 full 2'MOE, and Compound #106 full 2'oMe.

The structure of Compound ID #106 (SEQ ID NO 106) inducing upregulation of Progranulin in both H4 cells and hiPSC derived Microglia cells, is shown in FIG. 7.

Example 11: Full 2'MOE and 2'oMe Modified Versions of SEQ ID NO: 106

SEQ ID NO: 106 (TGGCCAGGGATCAGGG) was tested as both a full 2'MOE modified oligo (Compound #106 full 2'MOE) and a full 2'oMe modified oligo (Compound #106 full 2'oMe).

H4 neuroglioma cells seeded in 96 well plates 5000 pr well were treated with 10 µM final concentration of compounds for 5 days in 200 µL medium. Progranulin expression levels were evaluated in media after dilution 1:8 by ELISA from Abcam (ab252364). Compound #106 and Compound #106 full 2'MOE and Compound #106 full 2'oMe induced a ~2-fold increase in progranulin secretion to the media compared to PBS.

Figure 9:
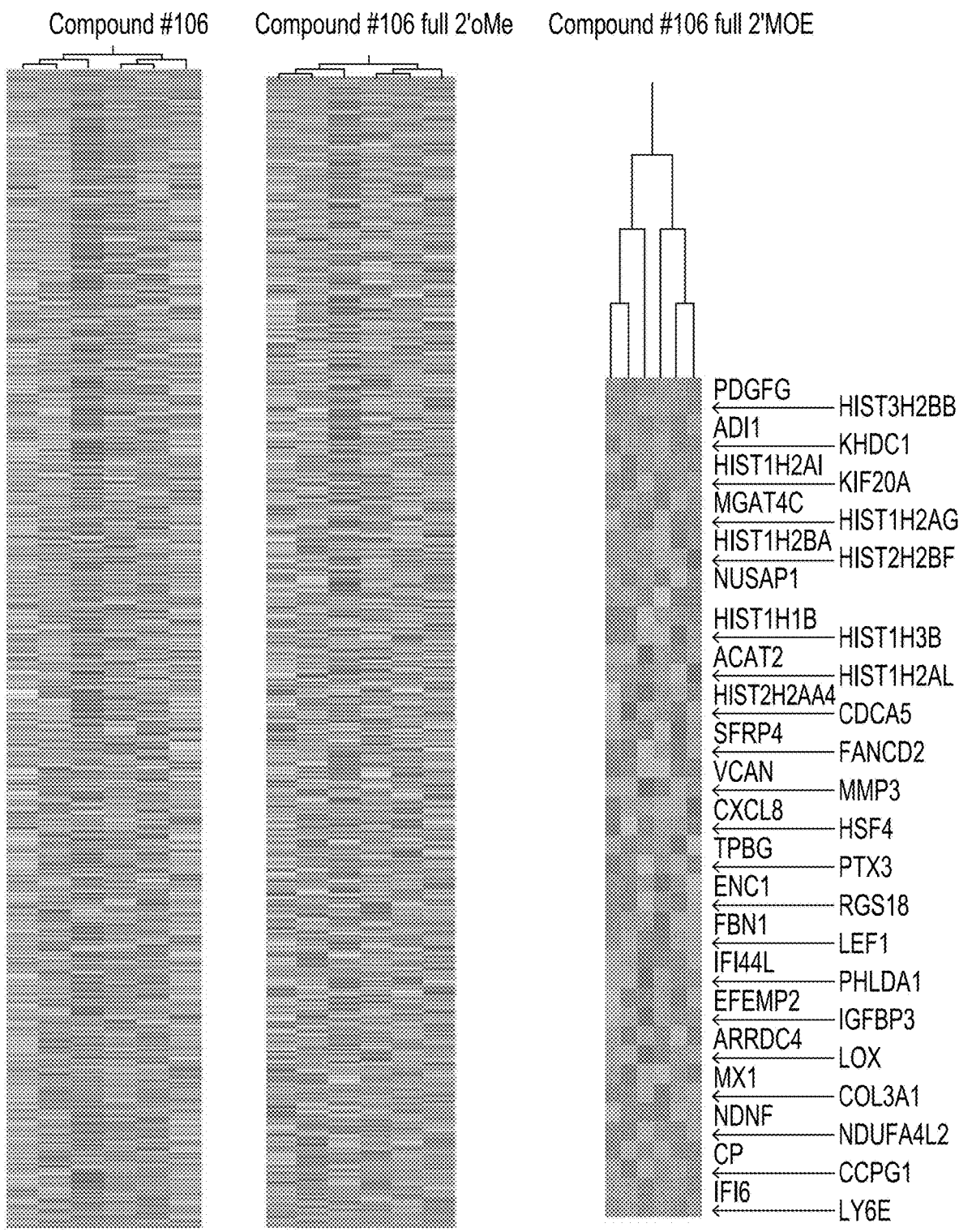
FIG. 9 shows heat maps indicating genes upregulated and down regulated relative to PBS control treated cells. Left is compound #106, middle is Compound #106 full 2'oMe and right is Compound #106 full 2'MOE.
Figure 10:
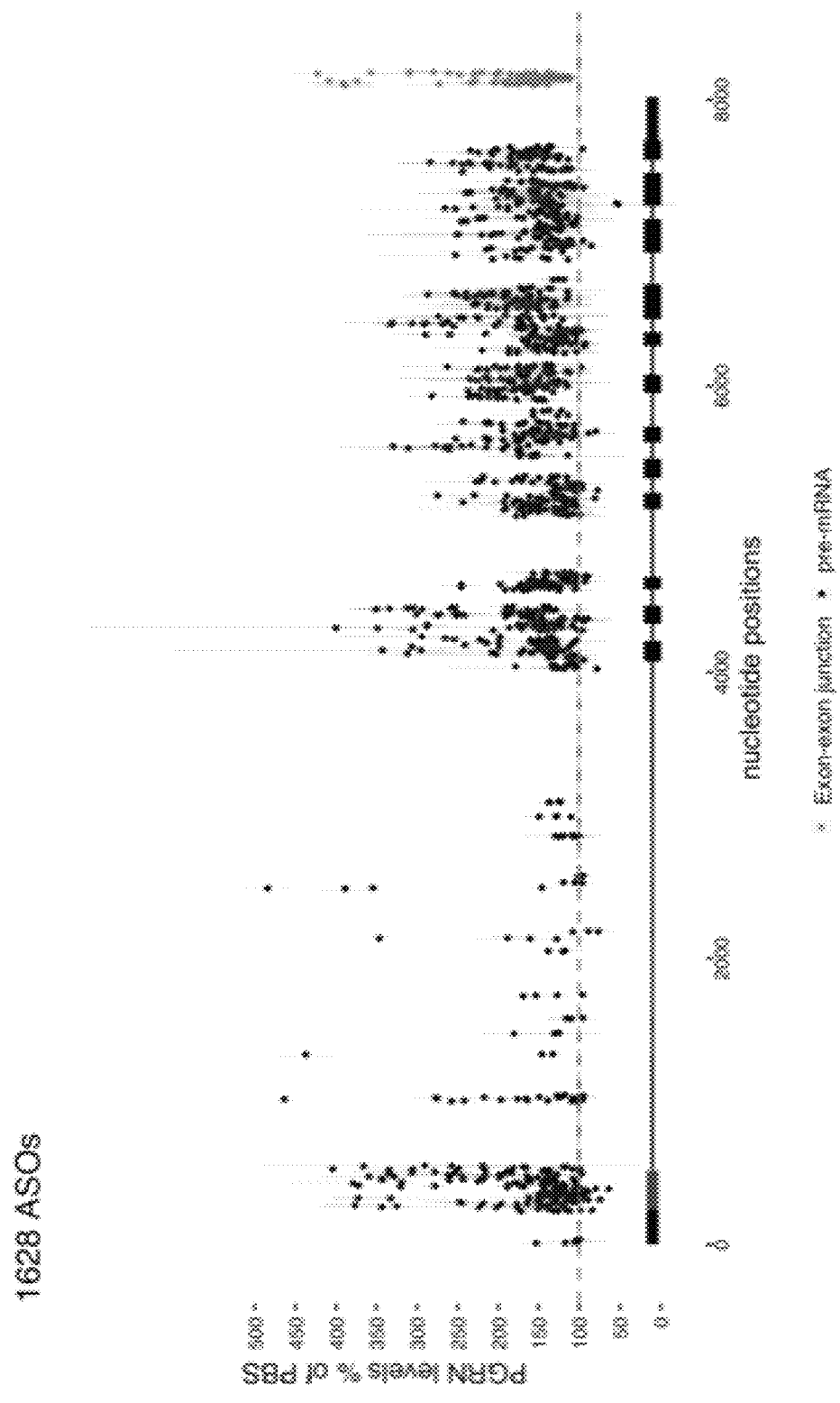
FIG. 10 is a plot showing the position of oligos within the progranulin precursor-mRNA (pre-mRNA) sequence (SEQ ID NO 3949) relative to the activity of the oligo. Oligos complementary to exon-exon junctions are plotted downstream of the schematic figure of the pre-mRNA

Example 12: Gene Transcript Regulation by Compound #106, Compound #106 Full 2'MOE and Compound #106 Full 2'oMe To understand the number of gene transcripts regulated by compound #106, Compound #106 full 2'MOE and Compound #106 full 2'oMe, H4 neuroglioma cells seeded in 48 well plates 15000 per well were treated with 10 µM final concentration of compounds for 5 days in 500 µL medium. mRNA was isolated using the MagNAPure 96 system (Roche) according to manufacturer's protocol. The purified mRNA were sent for gene expression array analysis at Eurofins Genomics, using Clariom™ S Arrays (ThermoFisher Scientific). Expression analysis was conducted using the Qlucore Omics Explorer software, using a two-group comparison and by adjusting the FDR<0.1. The number of genes regulated more than 2-fold either up and down compared to PBS were identified. Compound #106 showed 1207 genes regulated more than 2-fold, Compound #106 full 2'oMe showed 782 genes regulated more than 2-fold, whereas Compound #106 full 2'MOE only showed 43 transcripts regulated. FIG. 9 shows that Compound #106 full 2'MOE has less off-targets compared to compound #106 and Compound #106 full 2'oMe.

The genes regulated more than 2-fold with a FDR<0.1 are shown below.

Genes regulated more than 2-fold with a FDR<0.1 following treatment with Compound #106: AATF, ABCA1, ABCC2, ABCC3, ABCG1, ABLIM3, ACAT2, ACKR3, ACSL5, ACSS3, ACTA2, ACVR1B, ADAM9, ADAMTS16, ADAMTS19, ADAMTS3, ADAMTSL4, ADGRA3, ADGRB3, ADI1, ADRBK1, ADRM1, ADSL, AFAP1, AGT, AHCY, AHI1, AHNAK2, AHR, AJAP1, AKAP6, ALCAM, ALDH1L2, ALDH3A1, ALDOA, ALDOC, ALG8, ALKBH5, ALPK2, ALYREF, AMMECR1, AMMECR1L, AMPD2, AMTN, ANGPT1, ANK3, ANKRD18A, ANKRD44, ANLN, ANO7, ANPEP, ANTXR2, ANXA1, AOAH, APCDD1, APEX1, APH1A, APOBEC3B, APOL2, APOL3, APRT, AQP1, AQP3, ARAF, ARCN1, ARHGAP11B, ARHGAP35, ARHGAP8, ARHGEF2, ARL4A, ARMC6, ARPC4, ARPC4-TTLL3, ARRDC3, ARRDC4, ARSG, ASNA1, ASNS, ASPM, ASS1, ATAD2, ATN1, ATP6AP1L, ATP6VOA1, ATP8B3, ATXN2, ATXN2L, AVEN, B4GALT5, BCAM, BCL6, BDNF, BEX1, BHLHE40, BIRC5, BLID, BLM, BMP5, BNC2, BNIP3, BNIP3L, BSG, BTAF1, BUB1B, C10orf10, C10orf107, C12orf76, C17orf89, C1RL, C1orf174, C1orf21, C1orf52, C1orf53, C20orf24, C7orf26, C7orf73, C8orf4, C8orf48, C8orf58, CA12, CA5B, CA9, CACNG4, CACYBP, CALCOCO1, CALR, CAMK4, CAPNS1, CAPZB, CASC5, CASK, CBLB, CCBL1, CCDC102B, CCDC150, CCDC163P, CCDC34, CCNA2, CCNB1, CCNB2, CCND1, CCNE2, CCPG1, CCT2, CD151, CD24, CD55, CD96, CD99, CD99, CDC20, CDC42SE1, CDC45, CDC6, CDCA5, CDCA8, CDH6, CDH8, CDK1, CDKN1A, CDKN3, CDT1, CENPA, CENPF, CENPH, CENPI, CENPM, CENPN, CENPU, CENPW, CEP128, CEP19, CEP55, CEP78, CFC1, CFH, CFI, CFL1, CHAC1, CHAC2, CHAF1B, CHMP1B, CHP1, CHST15, CKAP2, CKS2, CLEC2D, CLIC4, CLIP4, CLK2, CLMN, CLSPN, CLSTN2, CLTA, CLTB, CMTM7, CNTNAP1, CNTNAP3, CNTNAP3B, CNTNAP3B, CNTNAP3P2, COASY, COBLL1, COG7, COL1A1, COL21A1, COL3A1, COL5A2, COLEC12, COMMD3-BMI1, COPRS, COPZ1, CORIN, CORO2B, COX2, COX5A, CP, CPA4, CPD, CPSF3, CRISPLD1, CSF1, CSGALNACT1, CTBP2, CTBS, CTH, CTNND1, CTSB, CTSC, CTSL, CTSO, CUL7, CXADR, CXCL14, CXCL8, CYB5D2, CYTL1, DACT1, DBI, DBN1, DCTPP1, DDIT4, DDR2, DDX39A, DDX46, DECR1, DEDD, DEPDC1, DEPTOR, DGKD, DGKD, DGKD, DGKD, DGKD, DGKD, DHCR24, DHFR, DHRS3, DHX15, DHX9, DLGAP5, DLX1, DMKN, DOCK10, DPT, DPYD, DPYSL2, DPYSL3, DPYSL5, DSEL, DSN1, DSTN, DTNBP1, DUSP6, E2F8, EBI3, EBP, EDC4, EDEM1, EDIL3, EEF1B2, EEPD1, EFEMP2, EFTUD1, EGLN3, EGR1, EID1, EIF5, EIF5A, EIF6, ELAVL2, EMP1, ENC1, ENGASE, ENO2, ENPP1, ENPP2, ENTPD4, EPAS1, EPHX1, EPT1, ERGIC1, ERH, ERN1, ERO1A, ERRFI1, ETV1, ETV5, EXO1, EXT1, EXT1, EYA4, FAM101B, FAM111A, FAM111B, FAM114A1, FAM127B, FAM13A, FAM13C, FAM155A, FAM155A, FAM155A, FAM160A2, FAM161A, FAM162A, FAM200B, FAM20B, FAM214B, FAM219A, FAM234A, FAM46A, FAM83D, FANCA, FANCD2, FANCI, FBL, FBN1, FBXO32, FBXO36, FBXO44, FBXO7, FCHSD1, FDPS, FDX1L, FEM1C, FEM1C, FEN1, FGF7, FH, FIBIN, FJX1, FKBP10, FKBP1A, FKBP1A-SDCBP2, FKBP9, FLOT1, FLOT2, FLRT2, FN1, FNBP4, FOSL1, FOSL2, FOXF1, FOXF2, FOXK1, FOXM1, FRMD4B, FSCN1, FSTL1, FSTL4, FTSJ2, FUCA1, FUNDC2, FURIN, FUS, FUT11, FXYD5, FYCO1, GABRE, GALNT1, GALNT13, GANAB, GAR1, GATAD1, GBA, GBE1, GCLC, GCSH, GDI1, GFPT1, GFRA1, GFRA2, GINS1, GINS2, GLCCI1, GLI3, GLIPR2, GLIS3, GLRX2, GLT8D2, GLUL, GML, GMNN, GNAI1, GPAA1, GPATCH2L, GPATCH4, GPI, GPNMB, GPR137C, GPR34, GPRC5B, GPT2, GRAMD1A, GRINA, GRM8, GRWD1, GTF3A, GTPBP6, GTPBP6, H2AFV, H2AFX, H2AFY2, H6PD, HDAC9, HELLS, HGF, HIBCH, HILPDA, HIST1H1B, HIST1H1C, HIST1H1D, HIST1H1E, HIST1H2AB, HIST1H2AG, HIST1H2AH, HIST1H2AI, HIST1H2AJ, HIST1H2AL, HIST1H2AM, HIST1H2BF, HIST1H2BG, HIST1H2BH, HIST1H2BI, HIST1H2BJ, HIST1H2BK, HIST1H2BL, HIST1H2BO, HIST1H3B, HIST1H3D, HIST1H3F, HIST1H3G, HIST1H3H, HIST1H4B, HIST1H4C, HIST1H4D, HIST1H4H, HIST1H41, HIST2H2AA3, HIST2H2AA4, HIST2H2AB, HIST2H2AC, HIST2H2BE, HIST2H2BF, HIST2H3A, HIST2H3A, HIST2H3D, HIST2H4A, HIST2H4B, HIST3H2A, HIST3H2BB, HJURP, HK2, HLTF, HMGB3, HMGCS1, HMGCS2, HNRNPM, HOXA13, HOXA3, HOXB3, HPCAL1, HS6ST2, HSD17B13, HSF4, HSP90AA1, HSPA13, HSPB3, HSPH1, HTATSF1, HTR7, ID2, ID3, IDH2, IDI1, IDO1, IER3, IFI16, IFI44L, IFITM1, IFITM2, IFITM3, IFNGR2, IGF2, IGF2BP3, IGFBP3, IGFBP5, IK, IL13RA1, IL13RA2, IL1R1, IL1RAP, IL20RB, IL32, IL6, INAFM1, INHBB, INSIG2, IRF9, ISY1, ITFG2, ITGA11, ITGA2, ITGA3, ITGA4, ITGA5, ITGA6, ITGA8, ITGAX, ITGB3, ITGB5, ITGB6, ITGBL1, ITM2C, ITPKB, JAK2, JAK2, JUN, KAZALD1, KCNQ3, KCTD11, KDM4C, KDM5C, KEAP1, KIAA0101, KIAA1456, KIF11, KIF14, KIF15, KIF15, KIF15, KIF15, KIF15, KIF18A, KIF20A, KIF22, KIF23, KIF2C, KIF4A, KIFC1, KLF10, KLF9, KLHL4, KNSTRN, KNTC1, KPNA2, KPTN, KRT17, KRT81, KYNU, LACTB, LAMA1, LAMB1, LAMTOR4, LANCL2, LBH, LEF1, LEFTY2, LHX8, LIF, LIFR, LIMCH1, LINC00473, LINGO2, LMAN1, LMBR1L, LMNB1, LMNB2, LMNTD2, LOC100130880, LOX, LPAR6, LPCAT1, LPXN, LRIG3, LRP1, LRRC1, LRRC15, LRRC17, LRRC23, LRRC8C, LRRTM4, LRRTM4, LSAMP, LSG1, LSM3, LSM5, LUZP1, LY6E, LYPD6B, MAGEA1, MAP1LC3C, MAP2K6, MAP3K7CL, MAP9, MAPK14, MAPK1IP1L, MAPK3, MAPRE3, MARS, MASP1, MATN2, MBOAT7, MCAT, MCFD2, MCM2, MCM3, MCM4, MCM5, MCM6, MCM7, MCM8, MCOLN1, MCTP2, MDH1B, MECOM, MEF2A, MEIS2, MELK, METTL15, MFAP3L, MFSD1, MFSD10, MGAT5, MGST3, MILR1, MIR99AHG, MKI67, MMAB, MMD, MMP13, MMP3, MNS1, MOCOS, MOCS2, MOGS, MORF4L2, MOSPD2, MPI, MPP7, MPPED2, MPRIP, MRPL3, MRPL51, MRPL57, MRPS11, MSANTD2, MSH2, MT1B, MT1G, MT1IP, MT1L, MT1X, MT2A, MTCH2, MTERF3, MTHFD1, MTIF2, MTPAP, MX1, MYADM, MYBL2, MYLK, MYO6, MYO6, NAGK, NALCN, NAMPT, NANOS1, NAP1L1, NAPA, NASP, NCAM1, NCAPD2, NCAPG, NCAPH, NCK1, NCKAP5, NCL, NCOA4, NCOA7, ND4L, NDC80, NDNF, NDRG1, NDUFA4L2, NDUFS6, NDUFS8, NEIL3, NETO2, NEU1, NEXN, NFAT5, NFE2, NFE2L1, NFKB2, NFKBIA, NFYB, NHEJ1, NHP2, NMI, NOL3, NPIPA1, NPIPA5, NPIPA7, NPIPA7, NPIPA8, NR2C1, NR2F1, NR4A1, NSDHL, NSMAF, NSUN4, NUAK1, NUSAP1, NXPH4, NYAP2, OAS1, OAS2, OASL, OCIAD2, ODC1, OGN, OGT, OLA1, OLFML2B, OLFML3, OR8B12, ORAI3, ORC1, ORC6, OSBPL3, OSGEP, OSMR, OXCT1, P4HA1, P4HA2, PABPC4, PAFAH1B3, PAK1IP1, PAN2, PAQR6, PARD3B, PARM1, PARP14, PCDH10, PCF11, PCMTD1, PCNA, PCNX, PCP4, PCYOX1L, PDE10A, PDE4B, PDE5A, PDGFD, PDGFRA, PDIA4, PDK1, PDLIM5, PELI1, PELO, PEPD, PFKFB4, PFKP, PGAM1, PGK1, PHF19, PHLDA1, PIDD1, PIF1, PIK3R3, PITPNM1, PITX1, PLA2G6, PLAC8, PLAGL1, PLAT, PLAU, PLD1, PLD1, PLEKHA2, PLEKHG1, PLEKHS1, PLIN2, PLK4, PLN, PLOD1, PLOD2, PLOD3, PLPP3, PLPP4, PLSCR1, PLXDC2, PLXNC1, PMEPA1, PMM2, PNPLA2, PNPLA6, PNRC1, PODXL, POLQ, POLR1E, POLR2J4, POLR3D, POMT1, PON2, POSTN, PPARGC1A, PPIL1, PPM1B, PPP1R37, PPP1R7, PPP1R8, PPP3CA, PQBP1, PRADC1, PRC1, PRH1, PRIM1, PRKAA2, PRKAB2, PRKAR1A, PRKDC, PRKG1, PROCR, PROZ, PRR4, PRRC2B, PRRT1, PRUNE2, PSAT1, PSD3, PSMA2, PSMB1, PSMD1, PSMD2, PSMD3, PSMD9, PSMG1, PSMG2, PTAR1, PTCHD1, PTGES, PTGES3L-AARSD1, PTGR2, PTGS2, PTPMT1, PTPN13, PTPRG, PTPRM, PTPRN2, PUS7L, PVRL2, QRICH2, RAB27A, RAB33B, RAB7B, RABEP2, RABGGTA, RAD51, RAD51AP1, RAD51C, RALGAPA2, RALGPS2, RANBP3L, RASA4, RASL11A, RBL1, RBL2, RBM3, RBM8A, RBPMS, RCN3, REC8, RECQL4, RELA, REPS1, RFC4, RFPL4A, RGL2, RGS10, RGS18, RGS2, RMI2, RNF144A, RNF145, RNF213, RNF24, RNPEP, RORA, RP11-307P5.1, RPP21, RPP30, RPP40, RPS26, RPS26, RPS6KA3, RRAGC, RRAS, RRBP1, RRM1, RRM2, RTKN2, RTN3, RUNX2, RWDD1, S100A10, SAFB2, SAMD15, SAMD5, SAMD8, SAT1, SATB2, SBNO2, SCAMP3, SCARA3, SCN9A, SCOC, SCRIB, SDC4, SEC14L2, SEC23B, SECISBP2L, SEL1L3, SEMA3C, SEMA4B, SEMA6D, SERHL2, SERINC5, SERPINA3, SETD5, SF3B1, SFR1, SFRP4, SGIP1, SGK1, SGOL2, SGSH, SH3BGRL3, SH3BP2, SHB, SHC1, SHC4, SHCBP1, SHISA5, SHMT1, SIDT2, SIGMAR1, SKA2, SLC14A1, SLC16A1, SLC16A1, SLC16A3, SLC16A4, SLC16A6, SLC1A3, SLC1A5, SLC20A1, SLC25A19, SLC25A36, SLC25A37, SLC26A11, SLC29A1, SLC29A4, SLC2A1, SLC2A14, SLC2A3, SLC35F5, SLC37A3, SLC43A2, SLC4A4, SLC6A6, SLC7A5, SLCO4A1, SLFN5, SLIT2, SLITRK2, SLPI, SMAD7, SMAD9, SMAGP, SMC3, SMIM3, SMOX, SMPD1, SMPDL3A, SNAI1, SNAPC3, SNED1, SNRNP25, SNRPF, SNX2, SNX33, SOBP, SOCS4, SOCS5, SORT1, SOST, SPC24, SPC25, SPDL1, SPOCD1, SPON2, SPP1, SPRY1, SPRY3, SPRY3, SPRY4, SQLE, SRM, SRPX2, SRRT, SSBP2, ST8SIA4, STAG3L4, STC1, STC2, STEAP1B, STEAP2, STEAP3, STIL, STK11IP, STRA6, STXBP5L, SURF4, SURF4, SURF4, SURF4, SUV39H1, SVIP, SYNC, SYNJ2, SYT14, SYTL2, TACC3, TADA3, TAF9, TAF9B, TAGLN2, TANGO6, TAPBP, TAS2R31, TBC1D1, TBC1D28, TBC1D31, TBL1X, TBXAS1, TCEAL2, TCEAL4, TCF19, TCHP, TCP1, TDO2, TEX264, TFAP2A, TFAP2C, TFPI, TFRC, TGFA, TGFB2, THTPA, TIMELESS, TIMM10, TIMP1, TIMP3, TIPARP, TM2D2, TM4SF1, TM9SF4, TMED4, TMED7-TICAM2, TMEM100, TMEM160, TMEM182, TMEM2, TMEM2, TMEM230, TMEM30A, TMEM39A, TMEM70, TMEM97, TMEM98, TMEM99, TMPO, TMSB15A, TMUB1, TNFRSF10B, TNFRSF1A, TNFRSF9, TNFSF10, TOE1, TOMM34, TOP2A, TOR3A, TP63, TPBG, TPCN1, TPM1, TPMT, TPX2, TRAPPC2L, TRAPPC4, TRAPPC5, TRIB2, TRIB3, TRIM22, TRIM25, TRIM36, TRIM5, TRIP10, TRIP13, TRIT1, TRMO, TROAP, TSPAN9, TSR2, TSR3, TTC25, TTC37, TTLL12, TUBG2, TVP23C, TWISTNB, TXN, TXNIP, TYMS, U2AF1, UBE2C, UBR7, UGGT2, UHRF1, UMPS, UNC93B1, UNG, USP3, VAT1, VCAM1, VCAN, VGF, VOPP1, VPS11, VRK1, VWA5A, WARS, WDR27, WDR34, WDR60, WDR62, WDR76, WDR90, WNT2B, WNT5B, WSB1, XBP1, XRCC2, XRCC3, XRCC6BP1, YEATS4, YIF1A, YY1AP1, ZBED6, ZBTB25, ZC4H2, ZDHHC15, ZDHHC4, ZNF160, ZNF326, ZNF358, ZNF382, ZNF395, ZNF414, ZNF511, ZNF512B, ZNF521, ZNF529-AS1, ZNF532, ZNF570, ZNF667, ZNF682, ZNF692, ZNF777, ZNF785, ZNF830, ZNF92, ZWILCH and ZWINT.

Genes regulated more than 2-fold with a FDR<0.1 following treatment with Compound #106 full 2'oMe: AARS, ABCA1, ABLIM1, ACAT2, ACSL5, ADAM9, ADAMTS16, ADAMTS19, ADAMTSL4, ADGRA2, ADRBK1, ADRM1, ADSSL1, AGPS, AGRN, AGT, AHNAK, AHNAK2, AHR, AJAP1, AK7, AKAP12, AKAP6, AKR1C2, AKR1C3, ALCAM, ALDH1L2, ALDH3A1, ALDOC, ALPK2, ALYREF, AMTN, ANK3, ANKRD44, ANPEP, ANTXR2, AOAH, AP4S1, APCDD1, AQP1, ARHGAP11B, ARHGDIB, ARHGEF2, ARL15, ARMC6, ARRDC3, ARRDC4, ARSG, ASPN, ATAD2, ATHL1, ATP13A2, ATP6AP1L, ATP6V1C1, ATXN1, AURKB, BANF1, BCAR3, BCAT1, BCL6, BCO1, BDNF, BEX1, BLID, BMP5, BNC2, BNIP3, BSG, BST2, BTAF1, BTG2, BTG3, BUB1, BUB1B, C10orf107, C14orf1, C14orf132, C1QTNF3, C3orf14, C3orf58, C4A, C4B, C8orf4, C9orf43, C9orf50, CA12, CA9, CACNG4, CALCB, CAMK4, CARS, CASK, CASP4, CBFA2T3, CCDC102B, CCDC34, CCNA2, CCPG1, CD24, CD55, CD82, CD96, CDC45, CDC6, CDCA3, CDCA5, CDCA8, CDH6, CDK1, CEBPG, CENPF, CENPI, CENPM, CENPN, CENPU, CEP128, CFH, CFI, CHAC1, CHEK1, CHL1, CHMP1B, CHRNA1, CHRNA9, CHST15, CLDND1, CLEC2B, CLIC2, CLIC5, CLMN, CLSTN2, CMKLR1, CMTM3, CNPPD1, CNTNAP1, CNTNAP3, CNTNAP3B, CNTNAP3B, CNTNAP3P2, COBLL1, COL1A1, COL3A1, COL5A2, COLEC12, CORIN, CP, CPA4, CSF1, CSGALNACT1, CSGALNACT2, CSNK1E, CTBP1, CTBS, CTH, CTNS, CTSC, CXADR, CXCL14, CXCL3, CXCL8, CYP51A1, CYTH3, DACT1, DACT1, DBI, DBN1, DDIT4, DDX39A, DDX58, DDX60, DECR1, DEPTOR, DET1, DGKD, DGKD, DGKD, DGKD, DGKD, DHCR24, DHCR7, DHFR, DHFR, DHRS3, DHX58, DLG3, DLGAP5, DLX1, DNAH5, DNAJB1, DOCK10, DPT, DPYSL3, DSEL, DSN1, DUSP10, DUSP6, EBP, EEPD1, EFEMP2, EFTUD1, EGLN3, EID1, EIF2AK2, ELAVL2, EMP1, ENC1, ENGASE, ENO1, ENO2, ENPP2, ENTPD4, EPAS1, ERICH1, ERO1A, ERRFI1, ETV1, EXO1, EXT1, EXT1, F3, FAM111A, FAM111B, FAM118B, FAM13A, FAM13C, FAM155A, FAM155A, FAM161A, FAM162A, FAM198B, FAM20C, FAM46A, FAM83D, FANCI, FAP, FAS, FBLN5, FBN1, FBXO32, FGF7, FJX1, FLOT1, FN1, FOXF2, FOXM1, FSTL1, FSTL4, FUT11, GABRE, GADD45A, GATAD1, GBE1, GCLC, GDF15, GDI1, GFRA1, GINS1, GINS2, GLRX, GLT8D2, GLUL, GMFG, GNAI1, GNPDA1, GPC4, GPCPD1, GPI, GPNMB, GPRC5B, GPS2, GPT2, GPX3, GRIP1, H2AFV, H2AFX, HACE1, HDAC9, HDLBP, HGF, HHAT, HIPK2, HIST1H1B, HIST1H1C, HIST1H1D, HIST1H1E, HIST1H2AG, HIST1H2AH, HIST1H2AI, HIST1H2AJ, HIST1H2AL, HIST1H2AM, HIST1H2BF, HIST1H2BH, HIST1H2BI, HIST1H2BJ, HIST1H2BK, HIST1H2BL, HIST1H3B, HIST1H3F, HIST1H3G, HIST1H3H, HIST1H4B, HIST1H4C, HIST1H4H, HIST2H2AA3, HIST2H2AA4, HIST2H2AB, HIST2H2AC, HIST2H2BE, HIST2H2BF, HIST2H3A, HIST2H3A, HIST2H3D, HIST2H4A, HIST2H4B, HIST3H2BB, HLA-DRA, HMCN1, HMGB3, HMGCR, HMGCS1, HMGN2, HNRNPM, HOXA3, HPCAL1, HS6ST2, HSD17B10, HSD17B13, HSF4, HSP90B1, HSPB3, HTR7, ID3, IDI1, IDO1, IER3, IFI16, IFI27, IFI44, IFI44L, IFI6, IFITM1, IFITM2, IFITM3, IGF1, IGFBP3, IGFBP5, IL13RA1, IL13RA2, IL1R1, IL20RB, IL6, IL7R, ILF2, INAFM1, INHBA, INHBB, INSIG1, INSIG2, IRF9, ITGA11, ITGA2, ITGA5, ITGA6, ITGA8, ITGAX, ITGB6, ITGBL1, ITPKB, JAK2, JUN, KBTBD11, KCNH1, KCNQ3, KIAA0101, KIAA1456, KIF11, KIF15, KIF15, KIF15, KIF20A, KIF22, KIF23, KIF26B, KIF2C, KIF4A, KIFC1, KIRREL3, KPNA2, KRT17, KRTAP9-3, KYNU, LACTB, LAMB1, LBH, LEF1, LEFTY1, LEMD1, LEPR, LFNG, LGR4, LIF, LIMCH1, LINC00473, LINC00663, LINC01565, LINGO2, LITAF, LMAN1, LMNB1, LMNB2, LOX, LPAR6, LPCAT1, LRIG3, LRRC15, LRRC23, LRRN1, LRRTM4, LSAMP, LSS, LST1, LXN, LY6E, LY6E, LYPD6B, MAP1LC3C, MAP2K6, MAP3K5, MAP3K7CL, MASP1, MB21D2, MCM2, MCM3, MCM4, MCM5, MCOLN1, MCTP2, MECOM, MEIS2, MELK, MERTK, MET, MFAP2, MFAP3L, MFAP4, MFSD10, MGLL, MGP, MILR1, MIR99AHG, MKI67, MMD, MMP13, MOCOS, MPI, MPP7, MPPED2, MSC, MSH2, MT1X, MTFR2, MTHFD1, MTIF2, MX1, MX2, MYBL2, MYLK, MYO5B, MYO6, NAMPT, NANOS1, NBL1, NBN, NCAM1, NCAPD2, NCAPG, NCKAP1, NCOA7, NDC80, NDNF, NDOR1, NDUFA4L2, NES, NEXN, NFE2, NFKBIA, NKAP, NNT, NOL3, NPAS2, NPIPA1, NPIPA5, NPIPA7, NPIPA8, NQO1, NR2F1, NREP, NTM, NUAK1, NUCB2, NUDT22, NUSAP1, NXPH4, NYAP2, OAS1, OAS2, OBFC1, OLFM1, OLFML2A, OLFML2B, OLFML3, OR5H1, OSBPL3, OSGEP, OSMR, OXCT1, P2RX7, P4HA1, PABPC1, PABPC1L2A, PADI3, PADI3, PAN2, PARM1, PARP1, PARP14, PARP9, PAX9, PCDH10, PCNA, PCNX, PCP4, PDE10A, PDE5A, PDGFD, PDGFRA, PDIK1L, PDK1, PDK2, PDLIM5, PEPD, PFKFB4, PFKP, PGK1, PHLDA1, PIDD1, PIK3R3, PITX1, PKD1, PLAC8, PLAT, PLAU, PLD1, PLD1, PLIN2, PLK1, PLK4, PLOD1, PLPP3, PLPP4, PLSCR1, PLXDC2, PMEPA1, PNPLA3, POFUT2, POLD2, POLR1E, POLR2J4, POSTN, POU6F1, PPARG, PPARGC1A, PPP1CC, PRC1, PREX2, PRICKLE1, PRIM1, PRKAA2, PRKD1, PROCR, PRR11, PRSS12, PRUNE2, PSD3, PSG4, PTCH1, PTCHD1, PTGES, PTGS2, PTPN13, PTPRM, PVRL2, PXDC1, PYROXD1, RAB27A, RAB43, RACGAP1, RAD54L, RALGAPA2, RANBP3L, RAP2B, RASL11A, RASL11B, RBL2, RBM3, RBPMS, RCN3, REC8, RELB, RGS10, RGS18, RGS2, RHOJ, RNF145, RNF217, RNFT2, RORA, RPS6KA3, RRAGC, RRM1, RTKN2, RUNX2, SAMD15, SAMD8, SAT1, SATB2, SBNO2, SC5D, SDC4, SDR42E1, SECISBP2L, SEL1L3, SEMA4B, SERINC5, SERPINB1, SERPINE2, SERTAD4, SESN3, SFRP4, SGIP1, SGK1, SGOL1, SGSH, SHC1, SHC4, SHCBP1, SHISA5, SHMT1, SIDT2, SIX1, SLC14A1, SLC16A3, SLC16A4, SLC16A6, SLC1A3, SLC20A1, SLC25A37, SLC29A1, SLC29A4, SLC2A14, SLC2A3, SLC39A8, SLC44A4, SLC4A4, SLC50A1, SLC7A5, SLC9A3R2, SLCO1C1, SLCO4A1, SLFN5, SLIT2, SLITRK2, SLPI, SMAD9, SNAI1, SNAP25, SNAPC1, SNX8, SORBS2, SORT1, SPAG4, SPC24, SPC25, SPDL1, SPECC1, SPOCD1, SPP1, SPRY1, SSBP2, ST8SIA4, STARD4, STAT1, STC1, STC2, STEAP2, STEAP3, STMN1, SULT1E1, SYNC, SYNGR1, SYNM, SYT14, TACC3, TAF9B, TBC1D2, TBC1D3L, TBL1X, TDO2, TET3, TFAP2C, TFB1M, TFPI, TFRC, TGFB2, TIMELESS, TIMP1, TIMP3, TIPARP, TK1, TLR3, TM4SF1, TMCO4, TMEM100, TMEM140, TMEM189, TMEM19, TMEM2, TMEM255A, TMEM257, TMEM97, TNC, TNFRSF10B, TNFRSF9, TNFSF10, TOB1, TOP2A, TP63, TPBG, TPM1, TPM2, TPX2, TRAPPC2L, TRIB2, TRIB3, TRIM36, TRIM49C, TSPAN2, TSPAN9, TUBA1A, TVP23C, TXK, TXNIP, TYMS, UAP1L1, UBR7, UHRF1, VASH2, VCAM1, VCAN, VEGFA, VGLL2, VWA5A, WARS, WDR60, WDR62, WDR76, WFDC3, WFS1, WNT2B, WSB1, XBP1, XRCC2, YARS, YIF1A, ZBTB25, ZFP36L2, ZNF395, ZNF521, ZNF667, ZNF804A and ZNF814.

Genes regulated more than 2-fold with a FDR<0.1 following treatment with Compound #106 full 2'MOE: ACAT2, ADI1, ARRDC4, CCPG1, CDCA5, COL3A1, CP, CXCL8, EFEMP2, ENC1, FANCD2, FBN1, HIST1H1B, HIST1H2AG, HIST1H2AI, HIST1H2AL, HIST1H2BA, HIST1H3B, HIST2H2AA4, HIST2H2BF, HIST3H2BB, HSF4, IFI44L, IFI6, IGFBP3, KHDC1, KIF20A, LEF1, LOX, LY6E, MGAT4C, MMP3, MX1, NDNF, NDUFA4L2, NUSAP1, PDGFD, PHLDA1, PTX3, RGS18, SFRP4, TPBG and VCAN.

Example 13

H4 neuroglioma cells seeded in 96 well plates 5000 pr well were treated with 10 µM final concentration of compounds for 5 days in 200 µL full growth medium. Progranulin expression levels were evaluated in the media after dilution 1:8 by ELISA from Abcam (ab252364) according to manufacturer's protocol. Progranulins levels were normalized to PBS treated cells and values above >1 therefore indicates an upregulation of PGRN protein levels. Table 4 list the compounds tested, their sequences and their corresponding target site on the PGRN mRNA as well as the Progranulin protein expression levels.

TABLE 4

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 693 | COMP ID 693 | TTTCTAGGGATCATGTGA | 10 | 27 | 10 | 27 | SEQ ID 2321 | TCACATGATCCCTAGAAA | 1.53 |
| SEQ ID 694 | COMP ID 694 | CATTTCTAGGGATCATGT | 12 | 29 | 12 | 29 | SEQ ID 2322 | ACATGATCCCTAGAAATG | 1.17 |
| SEQ ID 695 | COMP ID 695 | CCCATTTCTAGGGATCAT | 14 | 31 | 14 | 31 | SEQ ID 2323 | ATGATCCCTAGAAATGGG | no data |
| SEQ ID 696 | COMP ID 696 | ACCCCATTTCTAGGGATC | 16 | 33 | 16 | 33 | SEQ ID 2324 | GATCCCTAGAAATGGGGT | 1.06 |
| SEQ ID 697 | COMP ID 697 | ACACCCCATTTCTAGGGA | 18 | 35 | 18 | 35 | SEQ ID 2325 | TCCCTAGAAATGGGGTGT | no data |
| SEQ ID 698 | COMP ID 698 | CCACACCCCATTTCTAGG | 20 | 37 | 20 | 37 | SEQ ID 2326 | CCTAGAAATGGGGTGTGG | no data |
| SEQ ID 699 | COMP ID 699 | CCCCACACCCCATTTCTA | 22 | 39 | 22 | 39 | SEQ ID 2327 | TAGAAATGGGGTGTGGGG | no data |
| SEQ ID 700 | COMP ID 700 | CGCCCCACACCCCATTTC | 24 | 41 | 24 | 41 | SEQ ID 2328 | GAAATGGGGTGTGGGGCG | 1.02 |
| SEQ ID 701 | COMP ID 701 | CTCGCCCCACACCCCATT | 26 | 43 | 26 | 43 | SEQ ID 2329 | AATGGGGTGTGGGGCGAG | 1.03 |
| SEQ ID 702 | COMP ID 702 | CTCTCGCCCCACACCCCA | 28 | 45 | 28 | 45 | SEQ ID 2330 | TGGGGTGTGGGGCGAGAG | no data |
| SEQ ID 703 | COMP ID 703 | TCCTCTCGCCCCACACCC | 30 | 47 | 30 | 47 | SEQ ID 2331 | GGGTGTGGGGCGAGAGGA | 1.03 |
| SEQ ID 704 | COMP ID 704 | CTTCCTCTCGCCCCACAC | 32 | 49 | 32 | 49 | SEQ ID 2332 | GTGTGGGGCGAGAGGAAG | no data |
| SEQ ID 705 | COMP ID 705 | TGCTTCCTCTCGCCCCAC | 34 | 51 | 34 | 51 | SEQ ID 2333 | GTGGGGCGAGAGGAAGCA | 0.99 |
| SEQ ID 706 | COMP ID 706 | CCTGCTTCCTCTCGCCCC | 36 | 53 | 36 | 53 | SEQ ID 2334 | GGGGCGAGAGGAAGCAGG | 1 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 707 | COMP ID 707 | TGGCCAGGGATCAGGGCT | 139 | 156 | 139 | 156 | SEQ ID 2335 | AGCCCTGATCCCTGGCCA | 3.56 |
| SEQ ID 708 | COMP ID 708 | TTGGCCAGGGATCAGGGC | 140 | 157 | 140 | 157 | SEQ ID 2336 | GCCCTGATCCCTGGCCAA | 2.3 |
| SEQ ID 709 | COMP ID 709 | ATTGGCCAGGGATCAGGG | 141 | 158 | 141 | 158 | SEQ ID 2337 | CCCTGATCCCTGGCCAAT | 3.89 |
| SEQ ID 710 | COMP ID 710 | TGGCCAGGGATCAGGG | 141 | 156 | 141 | 156 | SEQ ID 2338 | CCCTGATCCCTGGCCA | 3.9 |
| SEQ ID 711 | COMP ID 711 | CTGCGTCCGACTCCGCGG | 232 | 249 | 232 | 249 | SEQ ID 2339 | CCGCGGAGTCGGACGCAG | 1.71 |
| SEQ ID 712 | COMP ID 712 | ACCTGCGTCCGACTCCGC | | | 234 | 251 | SEQ ID 2340 | GCGGAGTCGGACGCAGGT | 1.11 |
| SEQ ID 713 | COMP ID 713 | CTACCTGCGTCCGACTCC | | | 236 | 253 | SEQ ID 2341 | GGAGTCGGACGCAGGTAG | 1.27 |
| SEQ ID 714 | COMP ID 714 | TCCTACCTGCGTCCGACT | | | 238 | 255 | SEQ ID 2342 | AGTCGGACGCAGGTAGGA | 1.31 |
| SEQ ID 715 | COMP ID 715 | TCTCCTACCTGCGTCCGA | | | 240 | 257 | SEQ ID 2343 | TCGGACGCAGGTAGGAGA | 0.84 |
| SEQ ID 716 | COMP ID 716 | GCTCTCCTACCTGCGTCC | | | 242 | 259 | SEQ ID 2344 | GGACCGCAGGTAGGAGAGC | 0.99 |
| SEQ ID 717 | COMP ID 717 | CCGCTCTCCTACCTGCGT | | | 244 | 261 | SEQ ID 2345 | ACGCAGGTAGGAGAGCGG | 1.17 |
| SEQ ID 718 | COMP ID 718 | GGCCGCTCTCCTACCTGC | | | 246 | 263 | SEQ ID 2346 | GCAGGTAGGAGAGCGGCC | 1.16 |
| SEQ ID 719 | COMP ID 719 | GCGGCCGCTCTCCTACCT | | | 248 | 265 | SEQ ID 2347 | AGGTAGGAGAGCGGCCGC | 1.38 |
| SEQ ID 720 | COMP ID 720 | GCGCGGGCCGCTCTCCTAC | | | 250 | 267 | SEQ ID 2348 | GTAGGAGAGCGGCCGCGC | 1.5 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 721 | COMP ID 721 | CTGCGCGGCCGCTCTCCT | | | 252 | 269 | SEQ ID 2349 | AGGAGAGCCGGCCGCGCAG | 1.5 |
| SEQ ID 722 | COMP ID 722 | GTCTGCGCGGCCGCTCTC | | | 254 | 271 | SEQ ID 2350 | GAGAGCGGCCGCGCAGAC | 1.37 |
| SEQ ID 723 | COMP ID 723 | AGGTCTGCGCGGCCGCTC | | | 256 | 273 | SEQ ID 2351 | GAGCGGCCGCGCAGACCT | 1.76 |
| SEQ ID 724 | COMP ID 724 | AGAGGTCTGCGCGGCCGC | | | 258 | 275 | SEQ ID 2352 | GCGGCCGCGCAGACCTCT | 2.24 |
| SEQ ID 725 | COMP ID 725 | CGAGAGGTCTGCGCGGCC | | | 260 | 277 | SEQ ID 2353 | GGCCGCGCAGACCTCTCG | 2.02 |
| SEQ ID 726 | COMP ID 726 | GGCGAGAGGTCTGCGCGG | | | 262 | 279 | SEQ ID 2354 | CCGCGCAGACCTCTCGCC | 3.43 |
| SEQ ID 727 | COMP ID 727 | CAGGCGAGAGGTCTGCGC | | | 264 | 281 | SEQ ID 2355 | GCGCAGACCTCTCGCCTG | 1.76 |
| SEQ ID 728 | COMP ID 728 | AGCAGGCGAGAGGTCTGC | | | 266 | 283 | SEQ ID 2356 | GCAGACCTCTCGCCTGCT | 1.47 |
| SEQ ID 729 | COMP ID 729 | GGAGCAGGCGAGAGGTCT | | | 268 | 285 | SEQ ID 2357 | AGACCTCTCGCCTGCTCC | 1.38 |
| SEQ ID 730 | COMP ID 730 | CAGGAGCAGGCGAGAGGT | | | 270 | 287 | SEQ ID 2358 | ACCTCTCGCCTGCTCCTG | 3.25 |
| SEQ ID 731 | COMP ID 731 | GGCAGGAGCAGGCGAGAG | | | 272 | 289 | SEQ ID 2359 | CTCTCGCCTGCTCCTGCC | 1.44 |
| SEQ ID 732 | COMP ID 732 | TGGGCAGGAGCAGGCGAG | | | 274 | 291 | SEQ ID 2360 | CTCGCCTGCTCCTGCCCA | 3.77 |
| SEQ ID 733 | COMP ID 733 | CCTGGGCAGGAGCAGGCG | | | 276 | 293 | SEQ ID 2361 | CGCCTGCTCCTGCCCAGG | 1.22 |
| SEQ ID 734 | COMP ID 734 | CCCCTGGGCAGGAGCAGG | | | 278 | 295 | SEQ ID 2362 | CCTGCTCCTGCCCAGGGG | 1.37 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 735 | COMP ID 735 | GGCCCCTGGCCAGAGCA | | | 280 | 297 | SEQ ID 2363 | TGCTCCTGCCCAGGGGCC | no data |
| SEQ ID 736 | COMP ID 736 | CGGGGCCCTGGGCAGGAG | | | 282 | 299 | SEQ ID 2364 | CTCCTGCCCAGGGGCCCG | 1.77 |
| SEQ ID 737 | COMP ID 737 | GGCGGGCCCCTGGGCAGG | | | 284 | 301 | SEQ ID 2365 | CCTGCCCAGGGGCCCGCC | 1.97 |
| SEQ ID 738 | COMP ID 738 | CTGGCGGGCCCCTGGGCA | | | 286 | 303 | SEQ ID 2366 | TGCCCAGGGGCCCGCCAG | 1.64 |
| SEQ ID 739 | COMP ID 739 | CCCTGGCGGGCCCCTGGG | | | 288 | 305 | SEQ ID 2367 | CCCAGGGGCCCGCCAGGG | 2.19 |
| SEQ ID 740 | COMP ID 740 | GGCCCTGGCGGGCCCCTG | | | 290 | 307 | SEQ ID 2368 | CAGGGGCCCGCCAGGGCC | 1.3 |
| SEQ ID 741 | COMP ID 741 | ATGGCCCTGGCGGGCCCC | | | 292 | 309 | SEQ ID 2369 | GGGGCCCGCCAGGGCCAT | 2.44 |
| SEQ ID 742 | COMP ID 742 | ACATGGCCCTGGCGGGCC | | | 294 | 311 | SEQ ID 2370 | GGCCCGCCAGGGCCATGT | 1.07 |
| SEQ ID 743 | COMP ID 743 | TCACATGGCCCTGGCGGG | | | 296 | 313 | SEQ ID 2371 | CCCGCCAGGGCCATGTGA | 2.48 |
| SEQ ID 744 | COMP ID 744 | GCTCACATGGCCCTGGCG | | | 298 | 315 | SEQ ID 2372 | CGCCAGGGCCATGTGAGC | 1.48 |
| SEQ ID 745 | COMP ID 745 | AAGCTCACATGGCCCTGG | | | 300 | 317 | SEQ ID 2373 | CCAGGGCCATGTGAGCTT | 1.52 |
| SEQ ID 746 | COMP ID 746 | TCAAGCTCACATGGCCCT | | | 302 | 319 | SEQ ID 2374 | AGGGCCATGTGAGCTTGA | 1.16 |
| SEQ ID 747 | COMP ID 747 | CTCAAGCTCACATGGCCC | | | 303 | 320 | SEQ ID 2375 | GGGCCATGTGAGCTTGAG | 1.54 |
| SEQ ID 748 | COMP ID 748 | CCTCAAGCTCACATGGCC | | | 304 | 321 | SEQ ID 2376 | GGCCATGTGAGCTTGAGG | 1.28 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 749 | COMP ID 749 | CTCAAGCTCACATGGC | | | 305 | 320 | SEQ ID 2377 | GCCATGTGAGCTTGAG | 1.36 |
| SEQ ID 750 | COMP ID 750 | ACCTCAAGCTCACATGGC | | | 305 | 322 | SEQ ID 2378 | GCCATGTGAGCTTGAGGT | 1.38 |
| SEQ ID 751 | COMP ID 751 | AACCTCAAGCTCACATGG | | | 306 | 323 | SEQ ID 2379 | CCATGTGAGCTTGAGGTT | 1.01 |
| SEQ ID 752 | COMP ID 752 | GGAACCTCAAGCTCACAT | | | 308 | 325 | SEQ ID 2380 | ATGTGAGCTTGAGGTTCC | 1.16 |
| SEQ ID 753 | COMP ID 753 | GGGGAACCTCAAGCTCAC | | | 310 | 327 | SEQ ID 2381 | GTGAGCTTGAGGTTCCCC | 1.1 |
| SEQ ID 754 | COMP ID 754 | CAGGGGAACCTCAAGCTC | | | 312 | 329 | SEQ ID 2382 | GAGCTTGAGGTTCCCCTG | 0.89 |
| SEQ ID 755 | COMP ID 755 | TCCAGGGGAACCTCAAGC | | | 314 | 331 | SEQ ID 2383 | GCTTGAGGTTCCCCTGGA | 0.74 |
| SEQ ID 756 | COMP ID 756 | ACTCCAGGGGAACCTCAA | | | 316 | 333 | SEQ ID 2384 | TTGAGGTTCCCCTGGAGT | 1.03 |
| SEQ ID 757 | COMP ID 757 | AGACTCCAGGGGAACCTC | | | 318 | 335 | SEQ ID 2385 | GAGGTTCCCCTGGAGTCT | 0.94 |
| SEQ ID 758 | COMP ID 758 | TGAGACTCCAGGGGAACC | | | 320 | 337 | SEQ ID 2386 | GGTTCCCCTGGAGTCTCA | 1.61 |
| SEQ ID 759 | COMP ID 759 | GCTGAGACTCCAGGGGAA | | | 322 | 339 | SEQ ID 2387 | TTCCCCTGGAGTCTCAGC | 3.32 |
| SEQ ID 760 | COMP ID 760 | CGGCTGAGACTCCAGGGG | | | 324 | 341 | SEQ ID 2388 | CCCCTGGAGTCTCAGCCG | 3.72 |
| SEQ ID 761 | COMP ID 761 | TCCGGCTGAGACTCCAGG | | | 326 | 343 | SEQ ID 2389 | CCTGGAGTCTCAGCCGGA | 1.61 |
| SEQ ID 762 | COMP ID 762 | TCTCCGGCTGAGACTCCA | | | 328 | 345 | SEQ ID 2390 | TGGAGTCTCAGCCGGAGA | 1.27 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 763 | COMP ID 763 | TGTCTCCGCTGAGACTC | | | 330 | 347 | SEQ ID 2391 | GAGTCTCAGCCGGAGACA | no data |
| SEQ ID 764 | COMP ID 764 | GTTGTCTCCGGCTGAGAC | | | 332 | 349 | SEQ ID 2392 | GTCTCAGCCGGAGACAAC | 1.35 |
| SEQ ID 765 | COMP ID 765 | CTGTTGTCTCCGGCTGAG | | | 334 | 351 | SEQ ID 2393 | CTCAGCCGGAGACAACAG | 1.43 |
| SEQ ID 766 | COMP ID 766 | TTCTGTTGTCTCCGGCTG | | | 336 | 353 | SEQ ID 2394 | CAGCCGGAGACAACAGAA | 1.5 |
| SEQ ID 767 | COMP ID 767 | TCTTCTGTTGTCTCCGGC | | | 338 | 355 | SEQ ID 2395 | GCCGGAGACAACAGAAGA | 1.08 |
| SEQ ID 768 | COMP ID 768 | GTTCTTCTGTTGTCTCCG | | | 340 | 357 | SEQ ID 2396 | CGGAGACAACAGAAGAAC | 1.11 |
| SEQ ID 769 | COMP ID 769 | CGGTTCTTCTGTTGTCTC | | | 342 | 359 | SEQ ID 2397 | GAGACAACAGAAGAACCG | 1.23 |
| SEQ ID 770 | COMP ID 770 | AGCCGTTCTTCTGTTGTC | | | 344 | 361 | SEQ ID 2398 | GACAACAGAAGAACCGCT | 1.44 |
| SEQ ID 771 | COMP ID 771 | TAAGCGGTTCTTCTGTTG | | | 346 | 363 | SEQ ID 2399 | CAACAGAAGAACCGCTTA | 1.43 |
| SEQ ID 772 | COMP ID 772 | AGTAAGCGGTTCTTCTGT | | | 348 | 365 | SEQ ID 2400 | ACAGAAGAACCGCTTACT | 1.33 |
| SEQ ID 773 | COMP ID 773 | TCAGTAAGCGGTTCTTCT | | | 350 | 367 | SEQ ID 2401 | AGAAGAACCGCTTACTGA | 1.16 |
| SEQ ID 774 | COMP ID 774 | TTTCAGTAAGCGGTTCTT | | | 352 | 369 | SEQ ID 2402 | AAGAACCGCTTACTGAAA | 0.96 |
| SEQ ID 775 | COMP ID 775 | AGTTTCAGTAAGCGGTTC | | | 354 | 371 | SEQ ID 2403 | GAACCGCTTACTGAAACT | 1.5 |
| SEQ ID 776 | COMP ID 776 | GGAGTTTCAGTAAGCGGT | | | 356 | 373 | SEQ ID 2404 | ACCGCTTACTGAAACTCC | 1.46 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | End Position | Precursor-mRNA Position (SEQ ID NO 3949) Start Position | End Position | Target Site Sequence ID | Target Site Sequence | Relative Progranulin expression (Relative to PBS) |
|---|---|---|---|---|---|---|---|---|---|
| SEQ ID 777 | COMP ID 777 | AAGGAGTTTCAGTAAGCG | | | 358 | 375 | SEQ ID 2405 | CGCTTACTGAAACTCCTT | 1.38 |
| SEQ ID 778 | COMP ID 778 | CCAAGGAGTTTCAGTAAG | | | 360 | 377 | SEQ ID 2406 | CTTACTGAAACTCCTTGG | 1.29 |
| SEQ ID 779 | COMP ID 779 | CCCCAAGGAGTTTCAGTA | | | 362 | 379 | SEQ ID 2407 | TACTGAAACTCCTTGGGG | 1.37 |
| SEQ ID 780 | COMP ID 780 | ACCCCCAAGGAGTTTCAG | | | 364 | 381 | SEQ ID 2408 | CTGAAACTCCTTGGGGGT | 1 |
| SEQ ID 781 | COMP ID 781 | GAACCCCCAAGGAGTTTC | | | 366 | 383 | SEQ ID 2409 | GAAACCTCCTTGGGGGTTC | 0.89 |
| SEQ ID 782 | COMP ID 782 | CAGAACCCCCAAGGAGTT | | | 368 | 385 | SEQ ID 2410 | AACTCCTTGGGGGTTCTG | 1.22 |
| SEQ ID 783 | COMP ID 783 | ATCAGAACCCCCAAGGAG | | | 370 | 387 | SEQ ID 2411 | CTCCTTGGGGTTCTGAT | 1.07 |
| SEQ ID 784 | COMP ID 784 | GTATCAGAACCCCCAAGG | | | 372 | 389 | SEQ ID 2412 | CCTTGGGGGTTCTGATAC | 0.9 |
| SEQ ID 785 | COMP ID 785 | GTGTATCAGAACCCCCAA | | | 374 | 391 | SEQ ID 2413 | TTGGGGGTTCTGATACAC | 1.05 |
| SEQ ID 786 | COMP ID 786 | TAGTGTATCAGAACCCCC | | | 376 | 393 | SEQ ID 2414 | GGGGGTTCTGATACACTA | 1.02 |
| SEQ ID 787 | COMP ID 787 | CCTAGTGTATCAGAACCC | | | 378 | 395 | SEQ ID 2415 | GGGTTCTGATACACTAGG | 1.17 |
| SEQ ID 788 | COMP ID 788 | CCCCTAGTGTATCAGAAC | | | 380 | 397 | SEQ ID 2416 | GTTCTGATACACTAGGGG | 1.2 |
| SEQ ID 789 | COMP ID 789 | TCCCCCTAGTGTATCAGA | | | 382 | 399 | SEQ ID 2417 | TCTGATACACTAGGGGGA | 0.94 |
| SEQ ID 790 | COMP ID 790 | ACTCCCCCTAGTGTATCA | | | 384 | 401 | SEQ ID 2418 | TGATACACTAGGGGGAGT | 1.08 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 791 | COMP ID 791 | AAACTCCCCTAGTGTAT | | | 386 | 403 | SEQ ID 2419 | ATACACTAGGGGAGTTT | 1 |
| SEQ ID 792 | COMP ID 792 | TAAAACTCCCCCTAGTGT | | | 388 | 405 | SEQ ID 2420 | ACACTAGGGGAGTTTTA | 0.64 |
| SEQ ID 793 | COMP ID 793 | CATAAAACTCCCCCTAGT | | | 390 | 407 | SEQ ID 2421 | ACTAGGGGAGTTTTATG | 1.26 |
| SEQ ID 794 | COMP ID 794 | CCCATAAAACTCCCCCTA | | | 392 | 409 | SEQ ID 2422 | TAGGGGAGTTTTATGGG | 0.8 |
| SEQ ID 795 | COMP ID 795 | TTCCCATAAAACTCCCCC | | | 394 | 411 | SEQ ID 2423 | GGGGGAGTTTTATGGGAA | 0.99 |
| SEQ ID 796 | COMP ID 796 | CTTTCCCATAAAACTCCC | | | 396 | 413 | SEQ ID 2424 | GGGAGTTTTATGGGAAAG | 1.31 |
| SEQ ID 797 | COMP ID 797 | CTCTTTCCCATAAAACTC | | | 398 | 415 | SEQ ID 2425 | GAGTTTTATGGGAAAGAG | 1.44 |
| SEQ ID 798 | COMP ID 798 | TCCTCTTTCCCATAAAAC | | | 400 | 417 | SEQ ID 2426 | GTTTTATGGGAAAGAGGA | 1.89 |
| SEQ ID 799 | COMP ID 799 | CTTCCTCTTTCCCATAAA | | | 402 | 419 | SEQ ID 2427 | TTTATGGGAAAGAGGAAG | 1.25 |
| SEQ ID 800 | COMP ID 800 | TGCTTCCTCTTTCCCATA | | | 404 | 421 | SEQ ID 2428 | TATGGGAAAGAGGAAGCA | 3.2 |
| SEQ ID 801 | COMP ID 801 | ACTGCTTCCTCTTTCCCA | | | 406 | 423 | SEQ ID 2429 | TGGGAAAGAGGAAGCAGT | 1.68 |
| SEQ ID 802 | COMP ID 802 | TTACTGCTTCCTCTTTCC | | | 408 | 425 | SEQ ID 2430 | GGAAAGAGGAAGCAGTAA | 1.7 |
| SEQ ID 803 | COMP ID 803 | AATTACTGCTTCCTCTTT | | | 410 | 427 | SEQ ID 2431 | AAAGAGGAAGCAGTAATT | 2.78 |
| SEQ ID 804 | COMP ID 804 | GCAATTACTGCTTCCTCT | | | 412 | 429 | SEQ ID 2432 | AGAGGAAGCAGTAATTGC | 3.72 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 805 | COMP ID 805 | CTGCAATTACTGCTTCCT | | | 414 | 431 | SEQ ID 2433 | AGGAAGCAGTAATTGCAG | 1.17 |
| SEQ ID 806 | COMP ID 806 | CACTGCAATTACTGCTTC | | | 416 | 433 | SEQ ID 2434 | GAAGCAGTAATTGCAGTG | 1.22 |
| SEQ ID 807 | COMP ID 807 | GTCACTGCAATTACTGCT | | | 418 | 435 | SEQ ID 2435 | AGCAGTAATTGCAGTGAC | 1.87 |
| SEQ ID 808 | COMP ID 808 | GCGTCACTGCAATTACTG | | | 420 | 437 | SEQ ID 2436 | CAGTAATTGCAGTGACGC | 1.03 |
| SEQ ID 809 | COMP ID 809 | GGGCGTCACTGCAATTAC | | | 422 | 439 | SEQ ID 2437 | GTAATTGCAGTGACGCCC | 1.46 |
| SEQ ID 810 | COMP ID 810 | CGGGGCGTCACTGCAATT | | | 424 | 441 | SEQ ID 2438 | AATTGCAGTGACGCCCCG | 1.2 |
| SEQ ID 811 | COMP ID 811 | AACGGGGCGTCACTGCAA | | | 426 | 443 | SEQ ID 2439 | TTGCAGTGACGCCCCGTT | 1.39 |
| SEQ ID 812 | COMP ID 812 | CTAACGGGGCGTCACTGC | | | 428 | 445 | SEQ ID 2440 | GCAGTGACGCCCCGTTAG | 3.79 |
| SEQ ID 813 | COMP ID 813 | TTCTAACGGGGCGTCACT | | | 430 | 447 | SEQ ID 2441 | AGTCACGCCCCGTTAGAA | 1.79 |
| SEQ ID 814 | COMP ID 814 | CCTTCTAACGGGCGTCA | | | 432 | 449 | SEQ ID 2442 | TGACGCCCCGTTAGAAGG | 1.76 |
| SEQ ID 815 | COMP ID 815 | CCCCTTCTAACGGGGCGT | | | 434 | 451 | SEQ ID 2443 | ACGCCCCGTTAGAAGGGG | 1.36 |
| SEQ ID 816 | COMP ID 816 | AGCCCCTTCTAACGGGGC | | | 436 | 453 | SEQ ID 2444 | GCCCCGTTAGAAGGGGCT | 3.19 |
| SEQ ID 817 | COMP ID 817 | AAAGCCCCTTCTAACGGG | | | 438 | 455 | SEQ ID 2445 | CCCGTTAGAAGGGGCTTT | 1.06 |
| SEQ ID 818 | COMP ID 818 | AGAAAGCCCCTTCTAACG | | | 440 | 457 | SEQ ID 2446 | CGTTAGAAGGGGCTTTCT | 1.6 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 819 | COMP ID 819 | GTAGAAAGCCCCTTCTAA | | | 442 | 459 | SEQ ID 2447 | TTAGAAGGGCTTTCTAC | 2.25 |
| SEQ ID 820 | COMP ID 820 | AGGTAGAAAGCCCCTTCT | | | 444 | 461 | SEQ ID 2448 | AGAAGGGCTTTCTACCT | 1.29 |
| SEQ ID 821 | COMP ID 821 | GGAGGTAGAAAGCCCCTT | | | 446 | 463 | SEQ ID 2449 | AAGGGGCTTTCTACCTCC | 1.43 |
| SEQ ID 822 | COMP ID 822 | GGGGAGGTAGAAAGCCCC | | | 448 | 465 | SEQ ID 2450 | GGGGCTTTCTACCTCCCC | 1.64 |
| SEQ ID 823 | COMP ID 823 | CTGGGGAGGTAGAAAGCC | | | 450 | 467 | SEQ ID 2451 | GGCTTTCTACCTCCCCAG | 2.6 |
| SEQ ID 824 | COMP ID 824 | TGCTGGGGAGGTAGAAAG | | | 452 | 469 | SEQ ID 2452 | CTTTCTACCTCCCCAGCA | 3.42 |
| SEQ ID 825 | COMP ID 825 | AATGCTGGGGAGGTAGAA | | | 454 | 471 | SEQ ID 2453 | TTCTACCTCCCCAGCATT | 2.21 |
| SEQ ID 826 | COMP ID 826 | GGAATGCTGGGGAGGTAG | | | 456 | 473 | SEQ ID 2454 | CTACCTCCCCAGCATTCC | 2.43 |
| SEQ ID 827 | COMP ID 827 | GGGGAATGCTGGGGAGGT | | | 458 | 475 | SEQ ID 2455 | ACCTCCCCAGCATTCCCC | 1.6 |
| SEQ ID 828 | COMP ID 828 | TGGGGGAATGCTGGGGAG | | | 460 | 477 | SEQ ID 2456 | CTCCCCAGCATTCCCCA | 3.44 |
| SEQ ID 829 | COMP ID 829 | TTTGGGGAATGCTGGGG | | | 462 | 479 | SEQ ID 2457 | CCCCAGCATTCCCCAAA | 1.07 |
| SEQ ID 830 | COMP ID 830 | GCTTTGGGGAATGCTGG | | | 464 | 481 | SEQ ID 2458 | CCAGCATTCCCCAAAGC | 2.17 |
| SEQ ID 831 | COMP ID 831 | CTGCTTTGGGGAATGCT | | | 466 | 483 | SEQ ID 2459 | AGCATTCCCCAAAGCAG | 1.98 |
| SEQ ID 832 | COMP ID 832 | CCCTGCTTTGGGGAATG | | | 468 | 485 | SEQ ID 2460 | CATTCCCCAAAGCAGGG | 1.31 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | End Position | Precursor-mRNA Position (SEQ ID NO 3949) Start Position | End Position | Target Site Sequence ID | Target Site Sequence | Relative Progranulin expression (Relative to PBS) |
|---|---|---|---|---|---|---|---|---|---|
| SEQ ID 833 | COMP ID 833 | GTCCCTGCTTTGGGGAA | | | 470 | 487 | SEQ ID 2461 | TTCCCCAAAGCAGGGAC | 1.51 |
| SEQ ID 834 | COMP ID 834 | TGGTCCCTGCTTTGGGG | | | 472 | 489 | SEQ ID 2462 | CCCCAAAGCAGGGACCA | 1.4 |
| SEQ ID 835 | COMP ID 835 | TGTGGTCCCTGCTTTGGG | | | 474 | 491 | SEQ ID 2463 | CCCAAAGCAGGGACCACA | 3.59 |
| SEQ ID 836 | COMP ID 836 | GGTGTGGTCCCTGCTTTG | | | 476 | 493 | SEQ ID 2464 | CAAAGCAGGGACCACACC | 3.28 |
| SEQ ID 837 | COMP ID 837 | ATGGTGTGGTCCCTGCTT | | | 478 | 495 | SEQ ID 2465 | AAGCAGGGACCACACCAT | 2.45 |
| SEQ ID 838 | COMP ID 838 | GAATGGTGTGGTCCCTGC | | | 480 | 497 | SEQ ID 2466 | GCAGGGACCACACCATTC | 2.59 |
| SEQ ID 839 | COMP ID 839 | AGAATGGTGTGGTCCCTG | | | 481 | 498 | SEQ ID 2467 | CAGGGACCACACCATTCT | 2.2 |
| SEQ ID 840 | COMP ID 840 | GAATGGTGTGGTCCCT | | | 482 | 497 | SEQ ID 2468 | AGGGACCACACCATTC | 2.02 |
| SEQ ID 841 | COMP ID 841 | AAGAATGGTGTGGTCCCT | | | 482 | 499 | SEQ ID 2469 | AGGGACCACACCATTCTT | 1.64 |
| SEQ ID 842 | COMP ID 842 | CAAGAATGGTGTGGTCCC | | | 483 | 500 | SEQ ID 2470 | GGGACCACACCATTCTTG | 1.99 |
| SEQ ID 843 | COMP ID 843 | TCAAGAATGGTGTGGTCC | | | 484 | 501 | SEQ ID 2471 | GGACCACACCATTCTTGA | 2.61 |
| SEQ ID 844 | COMP ID 844 | CAAGAATGGTGTGGTC | | | 485 | 500 | SEQ ID 2472 | GACCACACCATTCTTG | 2.61 |
| SEQ ID 845 | COMP ID 845 | GTCAAGAATGGTGTGGTC | | | 485 | 502 | SEQ ID 2473 | GACCACACCATTCTTGAC | 2.79 |
| SEQ ID 846 | COMP ID 846 | GGTCAAGAATGGTGTGGT | | | 486 | 503 | SEQ ID 2474 | ACCACACCATTCTTGACC | 1.99 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 847 | COMP ID 847 | GGGTCAAGAATGGTGTGG | | | 487 | 504 | SEQ ID 2475 | CCACCACCATTCTTGACCC | 3.09 |
| SEQ ID 848 | COMP ID 848 | GGTCAAGAATGGTGTG | | | 488 | 503 | SEQ ID 2476 | CACACCATTCTTGACC | 1.65 |
| SEQ ID 849 | COMP ID 849 | TGGGTCAAGAATGGTGTG | | | 488 | 505 | SEQ ID 2477 | CACACCATTCTTGACCCA | 2.16 |
| SEQ ID 850 | COMP ID 850 | GCTGGGTCAAGAATGGTG | | | 490 | 507 | SEQ ID 2478 | CACCATTCTTGACCCAGC | 1.94 |
| SEQ ID 851 | COMP ID 851 | GAGCTGGGTCAAGAATGG | | | 492 | 509 | SEQ ID 2479 | CCATTCTTGACCCAGCTC | 1.28 |
| SEQ ID 852 | COMP ID 852 | TGGAGCTGGGTCAAGAAT | | | 494 | 511 | SEQ ID 2480 | ATTCTTGACCCAGCTCCA | 0.97 |
| SEQ ID 853 | COMP ID 853 | GGTGGAGCTGGGTCAAGA | | | 496 | 513 | SEQ ID 2481 | TCTTGACCCAGCTCCACC | 1.37 |
| SEQ ID 854 | COMP ID 854 | GGGGTGGAGCTGGGTCAA | | | 498 | 515 | SEQ ID 2482 | TTGACCCAGCTCCACCCC | 3.35 |
| SEQ ID 855 | COMP ID 855 | CAGGGGTGGAGCTGGGTC | | | 500 | 517 | SEQ ID 2483 | GACCCAGCTCCACCCCTG | 2.53 |
| SEQ ID 856 | COMP ID 856 | GACAGGGGTGGAGCTGGG | | | 502 | 519 | SEQ ID 2484 | CCCAGCTCCACCCCTGTC | 1.83 |
| SEQ ID 857 | COMP ID 857 | CCGACAGGGGTGGAGCTG | | | 504 | 521 | SEQ ID 2485 | CAGCTCCACCCCTGTCGG | 3.06 |
| SEQ ID 858 | COMP ID 858 | TACCGACAGGGGTGGAGC | | | 506 | 523 | SEQ ID 2486 | GCTCCACCCCTGTCGGTA | 0.99 |
| SEQ ID 859 | COMP ID 859 | CCTACCGACAGGGGTGGA | | | 508 | 525 | SEQ ID 2487 | TCCACCCCTGTCGGTAGG | 2.78 |
| SEQ ID 860 | COMP ID 860 | CACCTACCGACAGGGGTG | | | 510 | 527 | SEQ ID 2488 | CACCCCTGTCGGTAGGTG | 0.99 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 861 | COMP ID 861 | AGCACTACCGACAGGGG | | | 512 | 529 | SEQ ID 2489 | CCCCTGTCGGTAGGTGCT | 1.89 |
| SEQ ID 862 | COMP ID 862 | CCAGCACTTACCGACAGG | | | 514 | 531 | SEQ ID 2490 | CCTGTCGGTAGGTGCTGG | 1.45 |
| SEQ ID 863 | COMP ID 863 | AGCCAGCACTTACCGACA | | | 516 | 533 | SEQ ID 2491 | TGTCGGTAGGTGTGGCT | 1.36 |
| SEQ ID 864 | COMP ID 864 | GAAGCCAGCACTTACCGA | | | 518 | 535 | SEQ ID 2492 | TCGGTAGGTGCTGGCTTC | 1.44 |
| SEQ ID 865 | COMP ID 865 | AAGAAGCCAGCACTTACC | | | 520 | 537 | SEQ ID 2493 | GGTAGGTGCTGGCTTCTT | 1.37 |
| SEQ ID 866 | COMP ID 866 | GGAAGAAGCCAGCACCTA | | | 522 | 539 | SEQ ID 2494 | TAGGTGCTGGCTTCTTCC | 3.34 |
| SEQ ID 867 | COMP ID 867 | GGGGAAGAAGCCAGCACC | | | 524 | 541 | SEQ ID 2495 | GGTGCTGGCTTCTTCCCC | 2.17 |
| SEQ ID 868 | COMP ID 868 | GAGGGGAAGAAGCCAGCA | | | 526 | 543 | SEQ ID 2496 | TGCTGGCTTCTTCCCCTC | 3.05 |
| SEQ ID 869 | COMP ID 869 | GAGAGGGGAAGAAGCCAG | | | 528 | 545 | SEQ ID 2497 | CTGGCTTCTTCCCCTCTC | 4.04 |
| SEQ ID 870 | COMP ID 870 | AGGAGAGGGGAAGAAGCC | | | 530 | 547 | SEQ ID 2498 | GGCTTCTTCCCCTCTCCT | 1.08 |
| SEQ ID 871 | COMP ID 871 | CCAGGAGAGGGGAAGAAG | | | 532 | 549 | SEQ ID 2499 | CTTCTTCCCCTCTCCTGG | 2.49 |
| SEQ ID 872 | COMP ID 872 | CACCAGGAGAGGGGAAGA | | | 534 | 551 | SEQ ID 2500 | TCTTCCCCTCTCCTGGTG | 0.99 |
| SEQ ID 873 | COMP ID 873 | ACCACCAGGAGAGGGGAA | | | 536 | 553 | SEQ ID 2501 | TTCCCCTCTCCTGGTGGT | 1.81 |
| SEQ ID 874 | COMP ID 874 | CCACCACCAGGAGAGGGG | | | 538 | 555 | SEQ ID 2502 | CCCCTCCTGGTGGTGG | 1.65 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 875 | COMP ID 875 | CACCACCACCAGGAGAGG | | | 540 | 557 | SEQ ID 2503 | CCTCTCCTGGTGGTG | 1.2 |
| SEQ ID 876 | COMP ID 876 | CCCACCACCACCAGGAGA | | | 542 | 559 | SEQ ID 2504 | TCTCCTGGTGGTGGGG | 1.69 |
| SEQ ID 877 | COMP ID 877 | CACCCACCACCACCAGGA | | | 544 | 561 | SEQ ID 2505 | TCCTGGTGGTGGTGGGTG | 1.16 |
| SEQ ID 878 | COMP ID 878 | ACCACCCACCACCACCAG | | | 546 | 563 | SEQ ID 2506 | CTGGTGGTGGTGGGTGGT | 3.65 |
| SEQ ID 879 | COMP ID 879 | GAACCACCCACCACCACC | | | 548 | 565 | SEQ ID 2507 | GGTGGTGGTGGGTGGTTC | 2.58 |
| SEQ ID 880 | COMP ID 880 | GGGAACCACCCACCACCA | | | 550 | 567 | SEQ ID 2508 | TGGTGGTGGGTGGTTCCC | 2.19 |
| SEQ ID 881 | COMP ID 881 | GCGGGAACCACCCACCAC | | | 552 | 569 | SEQ ID 2509 | GTGGTGGGTGGTTCCCGC | 2.9 |
| SEQ ID 882 | COMP ID 882 | CCTCCTGTTTACCCTAAA | | | 999 | 1016 | SEQ ID 2510 | TTTAGGGTAAACAGGAGG | 1.02 |
| SEQ ID 883 | COMP ID 883 | CCCCTCCTGTTTACCCTA | | | 1001 | 1018 | SEQ ID 2511 | TAGGGTAAACAGGAGGGG | 2.58 |
| SEQ ID 884 | COMP ID 884 | GGCCCCTCCTGTTTACCC | | | 1003 | 1020 | SEQ ID 2512 | GGGTAAACAGGAGGGGCC | 1.09 |
| SEQ ID 885 | COMP ID 885 | GTGGCCCCTCCTGTTTAC | | | 1005 | 1022 | SEQ ID 2513 | GTAAACAGGAGGGGCCAC | 2.42 |
| SEQ ID 886 | COMP ID 886 | ATGTGGCCCCTCCTGTTT | | | 1007 | 1024 | SEQ ID 2514 | AAACAGGAGGGGCCACAT | 1.39 |
| SEQ ID 887 | COMP ID 887 | GCATGTGGCCCCTCCTGT | | | 1009 | 1026 | SEQ ID 2515 | ACAGGAGGGGCCACATGC | 1.64 |
| SEQ ID 888 | COMP ID 888 | GTGCATGTGGCCCCTCCT | | | 1011 | 1028 | SEQ ID 2516 | AGGAGGGGCCACATGCAC | 1.97 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 889 | COMP ID 889 | CTGTGCATGTGGCCCTC | | | 1013 | 1030 | SEQ ID 2517 | GAGGGGCCACATGCACAG | 0.96 |
| SEQ ID 890 | COMP ID 890 | ACCTGTGCATGTGCCCC | | | 1015 | 1032 | SEQ ID 2518 | GGGGCCACATGCACAGGT | 4.64 |
| SEQ ID 891 | COMP ID 891 | TTACCTGTGCATGTGGCC | | | 1017 | 1034 | SEQ ID 2519 | GGCCACATGCACAGGTAA | 1.75 |
| SEQ ID 892 | COMP ID 892 | AATTACCTGTGCATGTGG | | | 1019 | 1036 | SEQ ID 2520 | CCACATGCACAGGTAATT | 1.65 |
| SEQ ID 893 | COMP ID 893 | TGAATTACCTGTGCATGT | | | 1021 | 1038 | SEQ ID 2521 | ACATGCACAGGTAATTCA | 2.75 |
| SEQ ID 894 | COMP ID 894 | GGTGAATTACCTGTGCAT | | | 1023 | 1040 | SEQ ID 2522 | ATGCACAGGTAATTCACC | 1.08 |
| SEQ ID 895 | COMP ID 895 | CTGGTGAATTACCTGTGC | | | 1025 | 1042 | SEQ ID 2523 | GCACAGGTAATTCACCAG | 2.77 |
| SEQ ID 896 | COMP ID 896 | CCCTGGTGAATTACCTGT | | | 1027 | 1044 | SEQ ID 2524 | ACAGGTAATTCACCAGGG | 1.25 |
| SEQ ID 897 | COMP ID 897 | CTCCCTGGTGAATTACCT | | | 1029 | 1046 | SEQ ID 2525 | AGGTAATTCACCAGGGAG | 2.17 |
| SEQ ID 898 | COMP ID 898 | GGCTCCCTGGTGAATTAC | | | 1031 | 1048 | SEQ ID 2526 | GTAATTCACCAGGGAGCC | 1.49 |
| SEQ ID 899 | COMP ID 899 | TCGGCTCCCTGGTGAATT | | | 1033 | 1050 | SEQ ID 2527 | AATTCACCAGGGAGCCGA | 1 |
| SEQ ID 900 | COMP ID 900 | GTTCGGCTCCCTGGTGAA | | | 1035 | 1052 | SEQ ID 2528 | TTCACCAGGGAGCCGAAC | 1.21 |
| SEQ ID 901 | COMP ID 901 | GTGTTCGGCTCCCTGGTG | | | 1037 | 1054 | SEQ ID 2529 | CACCAGGGAGCCGAACAC | no data |
| SEQ ID 902 | COMP ID 902 | GAGTGTTCGGCTCCCTGG | | | 1039 | 1056 | SEQ ID 2530 | CCAGGGAGCCGAACACTC | 0.95 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 903 | COMP ID 903 | AGGAGTGTTCGGCTCCCT | | | 1041 | 1058 | SEQ ID 2531 | AGGGAGCCGAACACTCCT | 1.27 |
| SEQ ID 904 | COMP ID 904 | ACAGGAGTGTTCGGCTCC | | | 1043 | 1060 | SEQ ID 2532 | GGAGCCGAACACTCCTGT | no data |
| SEQ ID 905 | COMP ID 905 | GCACAGGAGTGTTCGGCT | | | 1045 | 1062 | SEQ ID 2533 | AGCCGAACACTCCTGTGC | 1.17 |
| SEQ ID 906 | COMP ID 906 | TGGATACCACTGCGGGGG | | | 1327 | 1344 | SEQ ID 2534 | CCCCCGCAGTGGTATCCA | 4.37 |
| SEQ ID 907 | COMP ID 907 | TGTGGATACCACTGCGGG | | | 1329 | 1346 | SEQ ID 2535 | CCCCAGTGGTATCCACA | 1.46 |
| SEQ ID 908 | COMP ID 908 | GGTGTGGATACCACTGCG | | | 1331 | 1348 | SEQ ID 2536 | CGCAGTGGTATCCACACC | 1.33 |
| SEQ ID 909 | COMP ID 909 | TGGGAATGGTGCAACAGG | | | 1472 | 1489 | SEQ ID 2537 | CCTGTTGCACCATTCCCA | 1.8 |
| SEQ ID 910 | COMP ID 910 | CCTGGGAATGGTGCAACA | | | 1474 | 1491 | SEQ ID 2538 | TGTTGCACCATTCCCAGG | 1.31 |
| SEQ ID 911 | COMP ID 911 | TGCCTGGGAATGGTGCAA | | | 1476 | 1493 | SEQ ID 2539 | TTGCACCATTCCCAGGCA | no data |
| SEQ ID 912 | COMP ID 912 | AGTGCCTGGGAATGGTGC | | | 1478 | 1495 | SEQ ID 2540 | GCACCATTCCCAGGCACT | 1.25 |
| SEQ ID 913 | COMP ID 913 | ACACCTATAACACGTCAC | | | 1578 | 1595 | SEQ ID 2541 | GTGACGTGTTATAGGTGT | 1.1 |
| SEQ ID 914 | COMP ID 914 | GGACACCTATAACACGTC | | | 1580 | 1597 | SEQ ID 2542 | GACGTGTTATAGGTGTCC | 1.15 |
| SEQ ID 915 | COMP ID 915 | AGGGACACCTATAACACG | | | 1582 | 1599 | SEQ ID 2543 | CGTGTTATAGGTGTCCCT | 0.95 |
| SEQ ID 916 | COMP ID 916 | CAGCCGACATGTCATTTC | | | 1736 | 1753 | SEQ ID 2544 | GAAATGACATGTCGGCTG | 1.69 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 917 | COMP ID 917 | CCCAGCCGACATGTCATT | | | 1738 | 1755 | SEQ ID 2545 | AATGACATGTCGGCTGGG | no data |
| SEQ ID 918 | COMP ID 918 | CGCCCAGCCGACATGTCA | | | 1740 | 1757 | SEQ ID 2546 | TGACATGTCGGCTGGGCG | 1.53 |
| SEQ ID 919 | COMP ID 919 | CACGCCCAGCCGACATGT | | | 1742 | 1759 | SEQ ID 2547 | ACATGTCGGCTGGGCGTG | 1.27 |
| SEQ ID 920 | COMP ID 920 | ACCACGCCCAGCCGACAT | | | 1744 | 1761 | SEQ ID 2548 | ATGTCGGCTGGGCGTGGT | 0.96 |
| SEQ ID 921 | COMP ID 921 | ATGGCATTTCTTTTTCTT | | | 2048 | 2065 | SEQ ID 2549 | AAGAAAAGAAATGCCAT | 1.2 |
| SEQ ID 922 | COMP ID 922 | ACATGGCATTTCTTTTTC | | | 2050 | 2067 | SEQ ID 2550 | GAAAAAGAAATGCCATGT | 1.38 |
| SEQ ID 923 | COMP ID 923 | TTACATGGCATTTCTTTT | | | 2052 | 2069 | SEQ ID 2551 | AAAAGAAATGCCATGTAA | 1.17 |
| SEQ ID 924 | COMP ID 924 | ATTTACATGGCATTTCTT | | | 2054 | 2071 | SEQ ID 2552 | AAGAAATGCCATGTAAAT | no data |
| SEQ ID 925 | COMP ID 925 | GGCTTACGATGGGTGCAT | | | 2135 | 2152 | SEQ ID 2553 | ATGCACCCATCGTAAGCC | 1.28 |
| SEQ ID 926 | COMP ID 926 | TAGGCTTACGATGGGTGC | | | 2137 | 2154 | SEQ ID 2554 | GCACCCATCGTAAGCCTA | 1.6 |
| SEQ ID 927 | COMP ID 927 | GTTAGGCTTACGATGGGT | | | 2139 | 2156 | SEQ ID 2555 | ACCCATCGTAAGCCTAAC | 3.46 |
| SEQ ID 928 | COMP ID 928 | TAGTTAGGCTTACGATGG | | | 2141 | 2158 | SEQ ID 2556 | CCATCGTAAGCCTAACTA | 1.89 |
| SEQ ID 929 | COMP ID 929 | AAAAAACCCCTGAAAATG | | | 2185 | 2202 | SEQ ID 2557 | CATTTTCAGGGGTTTTTT | 1.08 |
| SEQ ID 930 | COMP ID 930 | CAAAAAACCCCTGAAAA | | | 2187 | 2204 | SEQ ID 2558 | TTTTCAGGGGTTTTTTG | 0.76 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 931 | COMP ID 931 | AACAAAAAACCCTGAA | | | 2189 | 2206 | SEQ ID 2559 | TTCAGGGGTTTTTTGTT | 0.89 |
| SEQ ID 932 | COMP ID 932 | ATATATTGGGCGCGGTGG | | | 2487 | 2504 | SEQ ID 2560 | CCACCGCGCCCAATATAT | 3.89 |
| SEQ ID 933 | COMP ID 933 | AAATATATTGGGCGCGGT | | | 2489 | 2506 | SEQ ID 2561 | ACCGCGCCCAATATATTT | 4.84 |
| SEQ ID 934 | COMP ID 934 | CAAAATATATTGGGCGCG | | | 2491 | 2508 | SEQ ID 2562 | CGCGCCCAATATATTTTG | 3.54 |
| SEQ ID 935 | COMP ID 935 | ATCAAAATATATTGGGCG | | | 2493 | 2510 | SEQ ID 2563 | CGCCCAATATATTTTGAT | 1.46 |
| SEQ ID 936 | COMP ID 936 | TAAGTACAGTCAGCCCTC | | | 2526 | 2543 | SEQ ID 2564 | GAGGGCTGACTGTACTTA | 0.96 |
| SEQ ID 937 | COMP ID 937 | GTTAAGTACAGTCAGCCC | | | 2528 | 2545 | SEQ ID 2565 | GGGCTGACTGTACTTAAC | 1.05 |
| SEQ ID 938 | COMP ID 938 | ATGTTAAGTACAGTCAGC | | | 2530 | 2547 | SEQ ID 2566 | GCTGACTGTACTTAACAT | 1.19 |
| SEQ ID 939 | COMP ID 939 | CAGCCACACCTTTATTTT | | | 2572 | 2589 | SEQ ID 2567 | AAAATAAAGGTGTGGCTG | 1.01 |
| SEQ ID 940 | COMP ID 940 | CCCAGCCACACCTTTATT | | | 2574 | 2591 | SEQ ID 2568 | AATAAAGGTGTGGCTGGG | no data |
| SEQ ID 941 | COMP ID 941 | CACCCCAGCCACACCTTTA | | | 2576 | 2593 | SEQ ID 2569 | TAAAGGTGTGGCTGGGTG | 0.97 |
| SEQ ID 942 | COMP ID 942 | CACACCCAGCCACACCTT | | | 2578 | 2595 | SEQ ID 2570 | AAGGTGTGGCTGGGTGTG | 0.97 |
| SEQ ID 943 | COMP ID 943 | ACCACACCCAGCCACACC | | | 2580 | 2597 | SEQ ID 2571 | GGTGTGGCTGGGTGTGGT | 0.95 |
| SEQ ID 944 | COMP ID 944 | TCACCCCTTTTTTTTTT | | | 2850 | 2867 | SEQ ID 2572 | AAAAAAAAAGGGGGTGA | 1.24 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 945 | COMP ID 945 | GCTCACCCCCTTTTTTT | | | 2852 | 2869 | SEQ ID 2573 | AAAAAAAGGGGGTGAGC | 1.06 |
| SEQ ID 946 | COMP ID 946 | CTGCTCACCCCCTTTTTT | | | 2854 | 2871 | SEQ ID 2574 | AAAAAGGGGTGAGCAG | 1.05 |
| SEQ ID 947 | COMP ID 947 | GTCTGCTCACCCCCTTTT | | | 2856 | 2873 | SEQ ID 2575 | AAAAGGGGTGAGCAGAC | 1.29 |
| SEQ ID 948 | COMP ID 948 | ACGTCTGCTCACCCCCTT | | | 2858 | 2875 | SEQ ID 2576 | AAGGGGTGAGCAGACGT | 1.19 |
| SEQ ID 949 | COMP ID 949 | CCACGTCTGCTCACCCCC | | | 2860 | 2877 | SEQ ID 2577 | GGGGTGAGCAGACGTGG | 1 |
| SEQ ID 950 | COMP ID 950 | CACCACGTCTGCTCACCC | | | 2862 | 2879 | SEQ ID 2578 | GGGTGAGCAGACGTGGTG | 1.09 |
| SEQ ID 951 | COMP ID 951 | CTTTACTTTTATTTTATT | | | 2989 | 3006 | SEQ ID 2579 | AATAAAATAAAAGTAAAG | 1.1 |
| SEQ ID 952 | COMP ID 952 | ACCTTTACTTTTATTTTA | | | 2991 | 3008 | SEQ ID 2580 | TAAAATAAAAGTAAAGGT | 1.49 |
| SEQ ID 953 | COMP ID 953 | ATACCTTTACTTTTATTT | | | 2993 | 3010 | SEQ ID 2581 | AATAAAAGTAAAGGTAT | 1.29 |
| SEQ ID 954 | COMP ID 954 | TAATACCTTTACTTTTAT | | | 2995 | 3012 | SEQ ID 2582 | ATAAAGTAAAGGTATTA | 1.27 |
| SEQ ID 955 | COMP ID 955 | AAACAGTAATGTCTGTTG | | | 3090 | 3107 | SEQ ID 2583 | CAACAGACATTACTGTTT | 1.38 |
| SEQ ID 956 | COMP ID 956 | AAAAACAGTAATGTCTGT | | | 3092 | 3109 | SEQ ID 2584 | ACAGACATTACTGTTTT | 1.36 |
| SEQ ID 957 | COMP ID 957 | GCAAAAACAGTAATGTCT | | | 3094 | 3111 | SEQ ID 2585 | AGACATTACTGTTTTGC | 1.23 |
| SEQ ID 958 | COMP ID 958 | AAGCAAAAACAGTAATGT | | | 3096 | 3113 | SEQ ID 2586 | ACATTACTGTTTTGCTT | 1.25 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 959 | COMP ID 959 | TTAAGCCACGCCACCCT | | | 4023 | 4040 | SEQ ID 2587 | AGGGTGGCGTGGGCTTAA | 0.78 |
| SEQ ID 960 | COMP ID 960 | GCTTAAGCCACGCCACC | | | 4025 | 4042 | SEQ ID 2588 | GGTGGCGTGGGCTTAAGC | 1.18 |
| SEQ ID 961 | COMP ID 961 | CTGCTTAAGCCCACGCCA | | | 4027 | 4044 | SEQ ID 2589 | TGGCGTGGGCTTAAGCAG | 1.25 |
| SEQ ID 962 | COMP ID 962 | AACTGCTTAAGCCCACGC | | | 4029 | 4046 | SEQ ID 2590 | GCGTGGGCTTAAGCAGTT | 1.32 |
| SEQ ID 963 | COMP ID 963 | GCAACTGCTTAAGCCCAC | | | 4031 | 4048 | SEQ ID 2591 | GTGGGCTTAAGCAGTTGC | 1.31 |
| SEQ ID 964 | COMP ID 964 | TGGCAACTGCTTAAGCCC | | | 4033 | 4050 | SEQ ID 2592 | GGGCTTAAGCAGTTGCCA | 1.06 |
| SEQ ID 965 | COMP ID 965 | TCTGGCAACTGCTTAAGC | | | 4035 | 4052 | SEQ ID 2593 | GCTTAAGCAGTTGCCAGA | 1.28 |
| SEQ ID 966 | COMP ID 966 | CGTCTGGCAACTGCTTAA | | | 4037 | 4054 | SEQ ID 2594 | TTAAGCAGTTGCCAGACG | 1.02 |
| SEQ ID 967 | COMP ID 967 | AACGTCTGGCAACTGCTT | | | 4039 | 4056 | SEQ ID 2595 | AAGCAGTTGCCAGACGTT | 1.78 |
| SEQ ID 968 | COMP ID 968 | GGAACGTCTGGCAACTGC | | | 4041 | 4058 | SEQ ID 2596 | GCAGTTGCCAGACGTTCC | 1.32 |
| SEQ ID 969 | COMP ID 969 | AAGGAACGTCTGGCAACT | | | 4043 | 4060 | SEQ ID 2597 | AGTTGCCAGACGTTCCTT | 1.17 |
| SEQ ID 970 | COMP ID 970 | CCAAGGAACGTCTGGCAA | | | 4045 | 4062 | SEQ ID 2598 | TTGCCAGACGTTCCTTGG | 1.29 |
| SEQ ID 971 | COMP ID 971 | TACCAAGGAACGTCTGGC | | | 4047 | 4064 | SEQ ID 2599 | GCCAGACGTTCCTTGGTA | 1.34 |
| SEQ ID 972 | COMP ID 972 | AGTACCAAGGAACGTCTG | | | 4049 | 4066 | SEQ ID 2600 | CAGACGTTCCTTGGTACT | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 973 | COMP ID 973 | AAAGTACCAAGGAACGTC | | | 4051 | 4068 | SEQ ID 2601 | GACGTTCCTTGGTACTTT | 1.1 |
| SEQ ID 974 | COMP ID 974 | GCAAAGTACCAAGGAACG | | | 4053 | 4070 | SEQ ID 2602 | CGTTCCTTGGTACTTTGC | 1.05 |
| SEQ ID 975 | COMP ID 975 | CTGCAAAGTACCAAGGAA | | | 4055 | 4072 | SEQ ID 2603 | TTCCTTGGTACTTTGCAG | 1.11 |
| SEQ ID 976 | COMP ID 976 | AGCTCACCAGGGTCCACA | 258 | 275 | 4081 | 4098 | SEQ ID 2604 | TGTGGACCCTGGTGAGCT | 1.11 |
| SEQ ID 977 | COMP ID 977 | CCAGCTCACCAGGGTCCA | 260 | 277 | 4083 | 4100 | SEQ ID 2605 | TGGACCCTGGTGAGCTGG | 0.95 |
| SEQ ID 978 | COMP ID 978 | ACCCAGCTCACCAGGGTC | 262 | 279 | 4085 | 4102 | SEQ ID 2606 | GACCCTGGTGAGCTGGGT | 1.1 |
| SEQ ID 979 | COMP ID 979 | CCACCCAGCTCACCAGGG | 264 | 281 | 4087 | 4104 | SEQ ID 2607 | CCCTGGTGAGCTGGGTGG | 0.98 |
| SEQ ID 980 | COMP ID 980 | GGCCACCCAGCTCACCAG | 266 | 283 | 4089 | 4106 | SEQ ID 2608 | CTGGTGAGCTGGGTGGCC | no data |
| SEQ ID 981 | COMP ID 981 | AAGGCCACCCAGCTCACC | 268 | 285 | 4091 | 4108 | SEQ ID 2609 | GGTCAGCTGGGTGGCCTT | 0.98 |
| SEQ ID 982 | COMP ID 982 | TTAAGGCCACCCAGCTCA | 270 | 287 | 4093 | 4110 | SEQ ID 2610 | TGAGCTGGGTGGCCTTAA | 1.11 |
| SEQ ID 983 | COMP ID 983 | TGTTAAGGCCACCCAGCT | 272 | 289 | 4095 | 4112 | SEQ ID 2611 | AGCTGGGTGGCCTTAACA | no data |
| SEQ ID 984 | COMP ID 984 | GCTGTTAAGGCCACCCAG | 274 | 291 | 4097 | 4114 | SEQ ID 2612 | CTGGGTGGCCTTAACAGC | no data |
| SEQ ID 985 | COMP ID 985 | CTGCTGTTAAGGCCACCC | 276 | 293 | 4099 | 4116 | SEQ ID 2613 | GGGTGGCCTTAACAGCAG | 1.37 |
| SEQ ID 986 | COMP ID 986 | CCCTGCTGTTAAGGCCAC | 278 | 295 | 4101 | 4118 | SEQ ID 2614 | GTGGCCTTAACAGCAGGG | 1.15 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 987 | COMP ID 987 | AGCCTGCTGTTAAGGCC | 280 | 297 | 4103 | 4120 | SEQ ID 2615 | GGCCTTAACAGCAGGGCT | 1.32 |
| SEQ ID 988 | COMP ID 988 | CCAGCCCTGCTGTTAAGG | 282 | 299 | 4105 | 4122 | SEQ ID 2616 | CCTTAACAGCAGGGCTGG | no data |
| SEQ ID 989 | COMP ID 989 | CACCAGCCCTGCTGTTAA | 284 | 301 | 4107 | 4124 | SEQ ID 2617 | TTAACAGCAGGGCTGGTG | no data |
| SEQ ID 990 | COMP ID 990 | GCCACCAGCCCTGCTGTT | 286 | 303 | 4109 | 4126 | SEQ ID 2618 | AACAGCAGGGCTGGTGGC | no data |
| SEQ ID 991 | COMP ID 991 | CAGCCACCAGCCCTGCTG | 288 | 305 | 4111 | 4128 | SEQ ID 2619 | CAGCAGGGCTGGTGGCTG | 1.03 |
| SEQ ID 992 | COMP ID 992 | TCCAGCCACCAGCCCTGC | 290 | 307 | 4113 | 4130 | SEQ ID 2620 | GCAGGGCTGGTGGCTGGA | no data |
| SEQ ID 993 | COMP ID 993 | GTTCCAGCCACCAGCCCT | 292 | 309 | 4115 | 4132 | SEQ ID 2621 | AGGGCTGGTGGCTGGAAC | 1.08 |
| SEQ ID 994 | COMP ID 994 | GCGTTCCAGCCACCAGCC | 294 | 311 | 4117 | 4134 | SEQ ID 2622 | GGCTGGTGGCTGGAACGC | 1.3 |
| SEQ ID 995 | COMP ID 995 | CCGCGTTCCAGCCACCAG | 296 | 313 | 4119 | 4136 | SEQ ID 2623 | CTGGTGGCTGGAACGCGG | 1.1 |
| SEQ ID 996 | COMP ID 996 | CACCGCGTTCCAGCCACC | 298 | 315 | 4121 | 4138 | SEQ ID 2624 | GGTGGCTGGAACGCGGTG | 1.37 |
| SEQ ID 997 | COMP ID 997 | GGCACCGCGTTCCAGCCA | 300 | 317 | 4123 | 4140 | SEQ ID 2625 | TGGCTGGAACGCGGTGCC | 2.02 |
| SEQ ID 998 | COMP ID 998 | TGGGCACCGCGTTCCAGC | 302 | 319 | 4125 | 4142 | SEQ ID 2626 | GCTGGAACGCGGTGCCCA | 1.39 |
| SEQ ID 999 | COMP ID 999 | TCTGGGCACCGCGTTCCA | 304 | 321 | 4127 | 4144 | SEQ ID 2627 | TGGAACGCGGTGCCCAGA | 3.11 |
| SEQ ID 1000 | COMP ID 1000 | CATCTGGGCACCGCGTTC | 306 | 323 | 4129 | 4146 | SEQ ID 2628 | GAACGCGGTGCCCAGATG | |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1001 | COMP ID 1001 | ACCATCTGGGCACCGCGT | 308 | 325 | 4131 | 4148 | SEQ ID 2629 | ACGCGGTGCCCAGATGGT | 1.72 |
| SEQ ID 1002 | COMP ID 1002 | TGACCATCTGGGCACCGC | 310 | 327 | 4133 | 4150 | SEQ ID 2630 | GCGGTGCCCAGATGGTCA | 1.59 |
| SEQ ID 1003 | COMP ID 1003 | ACTGACCATCTGGGCACC | 312 | 329 | 4135 | 4152 | SEQ ID 2631 | GGTGCCCAGATGGTCAGT | 2.08 |
| SEQ ID 1004 | COMP ID 1004 | GAACTGACCATCTGGGCA | 314 | 331 | 4137 | 4154 | SEQ ID 2632 | TGCCCAGATGGTCAGTTC | 1.41 |
| SEQ ID 1005 | COMP ID 1005 | CAGAACTGACCATCTGGG | 316 | 333 | 4139 | 4156 | SEQ ID 2633 | CCCAGATGGTCAGTTCTG | 1.56 |
| SEQ ID 1006 | COMP ID 1006 | GGCAGAACTGACCATCTG | 318 | 335 | 4141 | 4158 | SEQ ID 2634 | CAGATGGTCAGTTCTGCC | 1.44 |
| SEQ ID 1007 | COMP ID 1007 | AGGGCAGAACTGACCATC | 320 | 337 | 4143 | 4160 | SEQ ID 2635 | GATGGTCAGTTCTGCCCT | 1.27 |
| SEQ ID 1008 | COMP ID 1008 | ACAGGGCAGAACTGACCA | 322 | 339 | 4145 | 4162 | SEQ ID 2636 | TGGTCAGTTCTGCCCTGT | 1.42 |
| SEQ ID 1009 | COMP ID 1009 | CCACAGGGCAGAACTGAC | 324 | 341 | 4147 | 4164 | SEQ ID 2637 | GTCAGTTCTGCCCTGTGG | 1.19 |
| SEQ ID 1010 | COMP ID 1010 | GGCCACAGGGCAGAACTG | 326 | 343 | 4149 | 4166 | SEQ ID 2638 | CAGTTCTGCCCTGTGGCC | 1.68 |
| SEQ ID 1011 | COMP ID 1011 | CAGGCCACAGGGCAGAAC | 328 | 345 | 4151 | 4168 | SEQ ID 2639 | GTTCTGCCCTGTGGCCTG | 3.42 |
| SEQ ID 1012 | COMP ID 1012 | AGCAGGCCACAGGGCAGA | 330 | 347 | 4153 | 4170 | SEQ ID 2640 | TCTGCCCTGTGGCCTGCT | 2.95 |
| SEQ ID 1013 | COMP ID 1013 | GCAGCAGGCCACAGGGCA | 332 | 349 | 4155 | 4172 | SEQ ID 2641 | TGCCCTGTGGCCTGCTGC | 1.37 |
| SEQ ID 1014 | COMP ID 1014 | AGGCAGCAGGCCACAGGG | 334 | 351 | 4157 | 4174 | SEQ ID 2642 | CCCTGTGGCCTGCTGCCT | 1.46 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1015 | COMP ID 1015 | CCAGGCAGCAGGCCACAG | 336 | 353 | 4159 | 4176 | SEQ ID 2643 | CTGTGGCCTGCTGCCTGG | 1.34 |
| SEQ ID 1016 | COMP ID 1016 | GTCCAGGCAGCAGGCCAC | 338 | 355 | 4161 | 4178 | SEQ ID 2644 | GTGGCCTGCTGCCTGGAC | 1.49 |
| SEQ ID 1017 | COMP ID 1017 | GGGTCCAGGCAGCAGGCC | 340 | 357 | 4163 | 4180 | SEQ ID 2645 | GGCCTGCTGCCTGGACCC | 1.45 |
| SEQ ID 1018 | COMP ID 1018 | CGGGGTCCAGGCAGCAGG | 342 | 359 | 4165 | 4182 | SEQ ID 2646 | CCTGCTGCCTGGACCCCG | 1.31 |
| SEQ ID 1019 | COMP ID 1019 | TCCGGGGTCCAGGCAGCA | 344 | 361 | 4167 | 4184 | SEQ ID 2647 | TGCTGCCTGGACCCCGGA | 1.37 |
| SEQ ID 1020 | COMP ID 1020 | CCTCCGGGGTCCAGGCAG | 346 | 363 | 4169 | 4186 | SEQ ID 2648 | CTGCCTGGACCCCGGAGG | 1.27 |
| SEQ ID 1021 | COMP ID 1021 | CTCCTCCGGGGTCCAGGC | 348 | 365 | 4171 | 4188 | SEQ ID 2649 | GCCTGGACCCCGGAGGAG | 1.5 |
| SEQ ID 1022 | COMP ID 1022 | GGCTCCTCCGGGGTCCAG | 350 | 367 | 4173 | 4190 | SEQ ID 2650 | CTGGACCCCGGAGGAGCC | 1.12 |
| SEQ ID 1023 | COMP ID 1023 | CTGGCTCCTCCGGGGTCC | 352 | 369 | 4175 | 4192 | SEQ ID 2651 | GGACCCCGGAGGAGCCAG | 1.99 |
| SEQ ID 1024 | COMP ID 1024 | AGCTGGCTCCTCCGGGGT | 354 | 371 | 4177 | 4194 | SEQ ID 2652 | ACCCCGGAGGAGCCAGCT | 3.06 |
| SEQ ID 1025 | COMP ID 1025 | GTAGCTGGCTCCTCCGGG | 356 | 373 | 4179 | 4196 | SEQ ID 2653 | CCCGGAGGAGCCAGCTAC | 1.47 |
| SEQ ID 1026 | COMP ID 1026 | CTGTAGCTGGCTCCTCCG | 358 | 375 | 4181 | 4198 | SEQ ID 2654 | CGGAGGAGCCAGCTACAG | 1.28 |
| SEQ ID 1027 | COMP ID 1027 | AGCTGTAGCTGGCTCCTC | 360 | 377 | 4183 | 4200 | SEQ ID 2655 | GAGGAGCCAGCTACAGCT | 1.51 |
| SEQ ID 1028 | COMP ID 1028 | GCAGCTGTAGCTGGCTCC | 362 | 379 | 4185 | 4202 | SEQ ID 2656 | GGAGCCAGCTACAGCTGC | 1.39 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1029 | COMP ID 1029 | CAGCAGCTGTAGCTGGCT | 364 | 381 | 4187 | 4204 | SEQ ID 2657 | AGCCAGCTACAGCTGCTG | no data |
| SEQ ID 1030 | COMP ID 1030 | GGCAGCAGCTGTAGCTGG | 366 | 383 | 4189 | 4206 | SEQ ID 2658 | CCAGCTACAGCTGCTGCC | 2.41 |
| SEQ ID 1031 | COMP ID 1031 | ACGGCAGCAGCTGTAGCT | 368 | 385 | 4191 | 4208 | SEQ ID 2659 | AGCTACAGCTGCTGCCGT | 1.28 |
| SEQ ID 1032 | COMP ID 1032 | GGACGGCAGCAGCTGTAG | 370 | 387 | 4193 | 4210 | SEQ ID 2660 | CTACAGCTGCTGCCGTCC | 1.38 |
| SEQ ID 1033 | COMP ID 1033 | GGGGACGGCAGCAGCTGT | 372 | 389 | 4195 | 4212 | SEQ ID 2661 | ACAGCTGCTGCCGTCCCC | 1.3 |
| SEQ ID 1034 | COMP ID 1034 | AAGGGGACGGCAGCAGCT | 374 | 391 | 4197 | 4214 | SEQ ID 2662 | AGCTGCTGCCGTCCCCTT | 1.09 |
| SEQ ID 1035 | COMP ID 1035 | AGAAGGGGACGGCAGCAG | 376 | 393 | 4199 | 4216 | SEQ ID 2663 | CTGCTGCCGTCCCCTTCT | 1.46 |
| SEQ ID 1036 | COMP ID 1036 | CCAGAAGGGGACGGCAGC | 378 | 395 | 4201 | 4218 | SEQ ID 2664 | GCTGCCGTCCCCTTCTGG | 1.43 |
| SEQ ID 1037 | COMP ID 1037 | CACCAGAAGGGGACGGCA | | | 4203 | 4220 | SEQ ID 2665 | TGCCGTCCCCTTCTGGTG | 2.14 |
| SEQ ID 1038 | COMP ID 1038 | CTCACCAGAAGGGGACGG | | | 4205 | 4222 | SEQ ID 2666 | CCGTCCCCTTCTGGTGAG | 1.57 |
| SEQ ID 1039 | COMP ID 1039 | CACTCACCAGAAGGGGAC | | | 4207 | 4224 | SEQ ID 2667 | GTCCCCTTCTGGTGAGTG | 1.99 |
| SEQ ID 1040 | COMP ID 1040 | GGCACTCACCAGAAGGGG | | | 4209 | 4226 | SEQ ID 2668 | CCCCTTCTGGTGAGTGCC | 1.3 |
| SEQ ID 1041 | COMP ID 1041 | GGGGCACTCACCAGAAGG | | | 4211 | 4228 | SEQ ID 2669 | CCTTCTGGTGAGTGCCCC | 1.55 |
| SEQ ID 1042 | COMP ID 1042 | GAGGGGCACTCACCAGAA | | | 4213 | 4230 | SEQ ID 2670 | TTCTGGTGAGTGCCCCTC | 1.6 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1043 | COMP ID 1043 | CTGAGGGGCACTCACCAG | | | 4215 | 4232 | SEQ ID 2671 | CTGGTGAGTGCCCCTCAG | 1.45 |
| SEQ ID 1044 | COMP ID 1044 | GGCTGAGGGGCACTCACC | | | 4217 | 4234 | SEQ ID 2672 | GGTGAGTGCCCCTCAGCC | 1.36 |
| SEQ ID 1045 | COMP ID 1045 | TAGGCTGAGGGGCACTCA | | | 4219 | 4236 | SEQ ID 2673 | TGAGTGCCCCTCAGCCTA | 1.04 |
| SEQ ID 1046 | COMP ID 1046 | CCTAGGCTGAGGGCACT | | | 4221 | 4238 | SEQ ID 2674 | AGTGCCCCTCAGCCTAGG | 1.28 |
| SEQ ID 1047 | COMP ID 1047 | TGCCTAGGCTGAGGGGCA | | | 4223 | 4240 | SEQ ID 2675 | TGCCCTCAGCCTAGGCA | 1.04 |
| SEQ ID 1048 | COMP ID 1048 | CTTGCCTAGGCTGAGGGG | | | 4225 | 4242 | SEQ ID 2676 | CCCCTCAGCCTAGGCAAG | 2.21 |
| SEQ ID 1049 | COMP ID 1049 | CTCTTGCCTAGGCTGAGG | | | 4227 | 4244 | SEQ ID 2677 | CCTCAGCCTAGGCAAGAG | 2.23 |
| SEQ ID 1050 | COMP ID 1050 | AGCTCTTGCCTAGGCTGA | | | 4229 | 4246 | SEQ ID 2678 | TCAGCCTAGGCAAGAGCT | 1.6 |
| SEQ ID 1051 | COMP ID 1051 | CCAGCTCTTGCCTAGGCT | | | 4231 | 4248 | SEQ ID 2679 | AGCCTAGGCAAGAGCTGG | 2.54 |
| SEQ ID 1052 | COMP ID 1052 | TGCCAGCTCTTGCCTAGG | | | 4233 | 4250 | SEQ ID 2680 | CCTAGGCAAGAGCTGGCA | 1.49 |
| SEQ ID 1053 | COMP ID 1053 | GCTGCCAGCTCTTGCCTA | | | 4235 | 4252 | SEQ ID 2681 | TAGGCAAGAGCTGGCAGC | .33 |
| SEQ ID 1054 | COMP ID 1054 | AGGCTGCCAGCTCTTGCC | | | 4237 | 4254 | SEQ ID 2682 | GGCAAGAGCTGGCAGCCT | 2.65 |
| SEQ ID 1055 | COMP ID 1055 | CCAGGCTGCCAGCTCTTG | | | 4239 | 4256 | SEQ ID 2683 | CAAGAGCTGGCAGCCTGG | 1.35 |
| SEQ ID 1056 | COMP ID 1056 | ACCCAGGCTGCCAGCTCT | | | 4241 | 4258 | SEQ ID 2684 | AGAGCTGGCAGCCTGGGT | 1.36 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1057 | COMP ID 1057 | AAACCCAGGCTGCCAGCT | | | 4243 | 4260 | SEQ ID 2685 | AGCTGGCAGCCTGGGTTT | 1.39 |
| SEQ ID 1058 | COMP ID 1058 | GAAAACCCAGGCTGCCAG | | | 4245 | 4262 | SEQ ID 2686 | CTGGCAGCCTGGGTTTTC | 1.98 |
| SEQ ID 1059 | COMP ID 1059 | GGGAAAACCCAGGCTGCC | | | 4247 | 4264 | SEQ ID 2687 | GGCAGCCTGGGTTTTCCC | 1.33 |
| SEQ ID 1060 | COMP ID 1060 | TTGGGAAAACCCAGGCTG | | | 4249 | 4266 | SEQ ID 2688 | CAGCCTGGGTTTTCCCAA | 1.98 |
| SEQ ID 1061 | COMP ID 1061 | CTTTGGGAAAACCCAGGC | | | 4251 | 4268 | SEQ ID 2689 | GCCTGGGTTTTCCCAAAG | 2.94 |
| SEQ ID 1062 | COMP ID 1062 | CTTGTGCCTGGCGTCCTC | | | 4291 | 4308 | SEQ ID 2690 | GAGGACGCCAGGCACAAG | 1.49 |
| SEQ ID 1063 | COMP ID 1063 | GACTTGTGCCTGGCGTCC | | | 4293 | 4310 | SEQ ID 2691 | GGACGCCAGGCACAAGTC | 2.06 |
| SEQ ID 1064 | COMP ID 1064 | CAGACTTGTGCCTGGCGT | | | 4295 | 4312 | SEQ ID 2692 | ACGCCAGGCACAAGTCTG | 0.96 |
| SEQ ID 1065 | COMP ID 1065 | CACAGACTTGTGCCTGGC | | | 4297 | 4314 | SEQ ID 2693 | GCCAGGCACAAGTCTGTG | 1.39 |
| SEQ ID 1066 | COMP ID 1066 | ACCACAGACTTGTGCCTG | | | 4299 | 4316 | SEQ ID 2694 | CAGGCACAAGTCTGTGGT | 3.05 |
| SEQ ID 1067 | COMP ID 1067 | AAACCACAGACTTGTGCC | | | 4301 | 4318 | SEQ ID 2695 | GGCACAAGTCTGTGGTTT | 1.3 |
| SEQ ID 1068 | COMP ID 1068 | ATAAACCACAGACTTGTG | | | 4303 | 4320 | SEQ ID 2696 | CACAAGTCTGTGGTTTAT | 1.03 |
| SEQ ID 1069 | COMP ID 1069 | TGATAAACCACAGACTTG | | | 4305 | 4322 | SEQ ID 2697 | CAAGTCTGTGGTTTATCA | 1.45 |
| SEQ ID 1070 | COMP ID 1070 | AATGATAAACCACAGACT | | | 4307 | 4324 | SEQ ID 2698 | AGTCTGTGGTTTATCATT | 1.7 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1071 | COMP ID 1071 | AAAATGATAAACCACAGA | | | 4309 | 4326 | SEQ ID 2699 | TCTGTGGTTTATCATTTT | 3.49 |
| SEQ ID 1072 | COMP ID 1072 | GGAAAATGATAAACCACA | | | 4311 | 4328 | SEQ ID 2700 | TGTGGTTTATCATTTTCC | 4 |
| SEQ ID 1073 | COMP ID 1073 | AGGGAAAATGATAAACCA | | | 4313 | 4330 | SEQ ID 2701 | TGGTTTATCATTTTCCCT | 1.86 |
| SEQ ID 1074 | COMP ID 1074 | ACAGGGAAAATGATAAAC | | | 4315 | 4332 | SEQ ID 2702 | GTTTATCATTTTCCCTGT | 1.21 |
| SEQ ID 1075 | COMP ID 1075 | AGACAGGGAAAATGATAA | | | 4317 | 4334 | SEQ ID 2703 | TTATCATTTTCCCTGTCT | 1.56 |
| SEQ ID 1076 | COMP ID 1076 | AAAGACAGGGAAAATGAT | | | 4319 | 4336 | SEQ ID 2704 | ATCATTTTCCCTGTCTTT | 1.42 |
| SEQ ID 1077 | COMP ID 1077 | AGAAAGACAGGGAAAATG | | | 4321 | 4338 | SEQ ID 2705 | CATTTTCCCTGTCTTTCT | 1.43 |
| SEQ ID 1078 | COMP ID 1078 | CTAGAAAGACAGGGAAAA | | | 4323 | 4340 | SEQ ID 2706 | TTTTCCCTGTCTTTCTAG | 2.88 |
| SEQ ID 1079 | COMP ID 1079 | TCCTAGAAAGACAGGGAA | | | 4325 | 4342 | SEQ ID 2707 | TTCCCTGTCTTTCTAGGA | 1.09 |
| SEQ ID 1080 | COMP ID 1080 | TGTCCTAGAAAGACAGGG | | | 4327 | 4344 | SEQ ID 2708 | CCCTGTCTTTCTAGGACA | 1.31 |
| SEQ ID 1081 | COMP ID 1081 | TTTGTCCTAGAAAGACAG | | | 4329 | 4346 | SEQ ID 2709 | CTGTCTTTCTAGGACAAA | 1.75 |
| SEQ ID 1082 | COMP ID 1082 | CATTTGTCCTAGAAAGAC | | | 4331 | 4348 | SEQ ID 2710 | GTCTTTCTAGGACAAATG | 1.43 |
| SEQ ID 1083 | COMP ID 1083 | GCCATTTGTCCTAGAAAG | | | 4333 | 4350 | SEQ ID 2711 | CTTTCTAGGACAAATGGC | 2.88 |
| SEQ ID 1084 | COMP ID 1084 | GGGCCATTTGTCCTAGAA | | | 4335 | 4352 | SEQ ID 2712 | TTCTAGGACAAATGGCCC | 1.65 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1085 | COMP ID 1085 | GTCGGCCATTTGTCCTAG | | | 4337 | 4354 | SEQ ID 2713 | CTAGGACAAATGGCCCAC | 1.73 |
| SEQ ID 1086 | COMP ID 1086 | TTGTGGGCCATTTGTCCT | | | 4339 | 4356 | SEQ ID 2714 | AGGACAAATGGCCCACAA | .52 |
| SEQ ID 1087 | COMP ID 1087 | TGTTGTGGGCCATTTGTC | 395 | 412 | 4341 | 4358 | SEQ ID 2715 | GACAAATGGCCCACAACA | 1.27 |
| SEQ ID 1088 | COMP ID 1088 | AGTGTTGTGGGCCATTTG | 397 | 414 | 4343 | 4360 | SEQ ID 2716 | CAAATGGCCCACAACACT | 1.35 |
| SEQ ID 1089 | COMP ID 1089 | TCAGTGTTGTGGGCCATT | 399 | 416 | 4345 | 4362 | SEQ ID 2717 | AATGGCCCACAACACTGA | 1.46 |
| SEQ ID 1090 | COMP ID 1090 | GCTTCAGTGTTGTGGGCCA | 401 | 418 | 4347 | 4364 | SEQ ID 2718 | TGGCCCACAACACTGAGC | 1.49 |
| SEQ ID 1091 | COMP ID 1091 | CTGCTCAGTGTTGTGGGC | 403 | 420 | 4349 | 4366 | SEQ ID 2719 | GCCCACAACACTGAGCAG | 1.51 |
| SEQ ID 1092 | COMP ID 1092 | GCCTGCTCAGTGTTGTGG | 405 | 422 | 4351 | 4368 | SEQ ID 2720 | CCACAACACTGAGCAGGC | 1.5 |
| SEQ ID 1093 | COMP ID 1093 | ATGCCTGCTCAGTGTTGT | 407 | 424 | 4353 | 4370 | SEQ ID 2721 | ACAACACTGAGCAGGCAT | 1.56 |
| SEQ ID 1094 | COMP ID 1094 | AGATGCCTGCTCAGTGTT | 409 | 426 | 4355 | 4372 | SEQ ID 2722 | AACACTGAGCAGGCATCT | 1.43 |
| SEQ ID 1095 | COMP ID 1095 | CCAGATGCCTGCTCAGTG | 411 | 428 | 4357 | 4374 | SEQ ID 2723 | CACTGAGCAGGCATCTGG | 1.21 |
| SEQ ID 1096 | COMP ID 1096 | ACCCAGATGCCTGCTCAG | 413 | 430 | 4359 | 4376 | SEQ ID 2724 | CTGAGCAGGCATCTGGGT | 0.95 |
| SEQ ID 1097 | COMP ID 1097 | CCACCCAGATGCCTGCTC | 415 | 432 | 4361 | 4378 | SEQ ID 2725 | GAGCAGGCATCTGGGTGG | 0.95 |
| SEQ ID 1098 | COMP ID 1098 | GGCCACCCAGATGCCTGC | 417 | 434 | 4363 | 4380 | SEQ ID 2726 | GCAGGCATCTGGGTGGCC | 1.25 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1099 | COMP ID 1099 | GGGGCCACCCAGATGCCT | 419 | 436 | 4365 | 4382 | SEQ ID 2727 | AGGCATCTGGGTGGCCCC | 1.44 |
| SEQ ID 1100 | COMP ID 1100 | CAGGGGCCACCCAGATGC | 421 | 438 | 4367 | 4384 | SEQ ID 2728 | GCATCTGGGTGGCCCCTG | 1.44 |
| SEQ ID 1101 | COMP ID 1101 | GGCAGGGGCCACCCAGAT | 423 | 440 | 4369 | 4386 | SEQ ID 2729 | ATCTGGGTGGCCCCTGCC | 1.05 |
| SEQ ID 1102 | COMP ID 1102 | CTGGCAGGGGCCACCCAG | 425 | 442 | 4371 | 4388 | SEQ ID 2730 | CTGGGTGGCCCCTGCCAG | 1.19 |
| SEQ ID 1103 | COMP ID 1103 | ACCTGGCAGGGGCCACCC | 427 | 444 | 4373 | 4390 | SEQ ID 2731 | GGGTGGCCCCTGCCAGGT | 0.94 |
| SEQ ID 1104 | COMP ID 1104 | CAACCTGGCAGGGGCCAC | 429 | 446 | 4375 | 4392 | SEQ ID 2732 | GTGGCCCCTGCCAGGTTG | 0.89 |
| SEQ ID 1105 | COMP ID 1105 | ATCAACCTGGCAGGGGCC | 431 | 448 | 4377 | 4394 | SEQ ID 2733 | GGCCCCTGCCAGGTTGAT | 1.01 |
| SEQ ID 1106 | COMP ID 1106 | GCATCAACCTGGCAGGGG | 433 | 450 | 4379 | 4396 | SEQ ID 2734 | CCCCTGCCAGGTTGATGC | 1.46 |
| SEQ ID 1107 | COMP ID 1107 | GGGCATCAACCTGGCAGG | 435 | 452 | 4381 | 4398 | SEQ ID 2735 | CCTGCCAGGTTGATGCCC | 1.04 |
| SEQ ID 1108 | COMP ID 1108 | GTGGGCATCAACCTGGCA | 437 | 454 | 4383 | 4400 | SEQ ID 2736 | TGCCAGGTTGATGCCCAC | 1.21 |
| SEQ ID 1109 | COMP ID 1109 | CAGTGGGCATCAACCTGG | 439 | 456 | 4385 | 4402 | SEQ ID 2737 | CCAGGTTGATGCCCACTG | 1.61 |
| SEQ ID 1110 | COMP ID 1110 | AGCAGTGGGCATCAACCT | 441 | 458 | 4387 | 4404 | SEQ ID 2738 | AGGTTGATGCCCACTGCT | 1.46 |
| SEQ ID 1111 | COMP ID 1111 | AGAGCAGTGGGCATCAAC | 443 | 460 | 4389 | 4406 | SEQ ID 2739 | GTTGATGCCCACTGCTCT | 1.91 |
| SEQ ID 1112 | COMP ID 1112 | GCAGAGCAGTGGGCATCA | 445 | 462 | 4391 | 4408 | SEQ ID 2740 | TGATGCCCACTGCTCTGC | 1.64 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1113 | COMP ID 1113 | CGGCAGAGCAGTGGCAT | 447 | 464 | 4393 | 4410 | SEQ ID 2741 | ATGCCACTGCTCTGCCG | 1.71 |
| SEQ ID 1114 | COMP ID 1114 | GCCGGCAGAGCAGTGGGC | 449 | 466 | 4395 | 4412 | SEQ ID 2742 | GCCCACTGCTCTGCCGGC | 1.56 |
| SEQ ID 1115 | COMP ID 1115 | TGGCCGGCAGAGCAGTGG | 451 | 468 | 4397 | 4414 | SEQ ID 2743 | CCACTGCTCTGCCGGCCA | 2.52 |
| SEQ ID 1116 | COMP ID 1116 | AGTGGCCGGCAGAGCAGT | 453 | 470 | 4399 | 4416 | SEQ ID 2744 | ACTGCTCTGCCGGCCACT | 2.42 |
| SEQ ID 1117 | COMP ID 1117 | GGAGTGGCCGGCAGAGCA | 455 | 472 | 4401 | 4418 | SEQ ID 2745 | TGCTCTGCCGGCCACTCC | 2.76 |
| SEQ ID 1118 | COMP ID 1118 | CAGGAGTGGCCGGCAGAG | 457 | 474 | 4403 | 4420 | SEQ ID 2746 | CTCTGCCGGCCACTCCTG | 2.72 |
| SEQ ID 1119 | COMP ID 1119 | TGCAGGAGTGGCCGGCAG | 459 | 476 | 4405 | 4422 | SEQ ID 2747 | CTGCCGGCCACTCCTGCA | 2.53 |
| SEQ ID 1120 | COMP ID 1120 | GATGCAGGAGTGGCCGGC | 461 | 478 | 4407 | 4424 | SEQ ID 2748 | GCCGGCCACTCCTGCATC | 3.01 |
| SEQ ID 1121 | COMP ID 1121 | AAGATGCAGGAGTGGCCG | 463 | 480 | 4409 | 4426 | SEQ ID 2749 | CGGCCACTCCTGCATCTT | 2.48 |
| SEQ ID 1122 | COMP ID 1122 | TAAAGATGCAGGAGTGGC | 465 | 482 | 4411 | 4428 | SEQ ID 2750 | GCCACTCCTGCATCTTTA | 2.48 |
| SEQ ID 1123 | COMP ID 1123 | GGTAAAGATGCAGGAGTG | 467 | 484 | 4413 | 4430 | SEQ ID 2751 | CACTCCTGCATCTTTACC | 1.85 |
| SEQ ID 1124 | COMP ID 1124 | ACGGTAAAGATGCAGGAG | 469 | 486 | 4415 | 4432 | SEQ ID 2752 | CTCCTGCATCTTTACCGT | 1.92 |
| SEQ ID 1125 | COMP ID 1125 | AGACGGTAAAGATGCAGG | 471 | 488 | 4417 | 4434 | SEQ ID 2753 | CCTGCATCTTTACCGTCT | 1.59 |
| SEQ ID 1126 | COMP ID 1126 | TGAGACGGTAAAGATGCA | 473 | 490 | 4419 | 4436 | SEQ ID 2754 | TGCATCTTTACCGTCTCA | 1.73 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1127 | COMP ID 1127 | CCTGAGACGGTAAAGATG | 475 | 492 | 4421 | 4438 | SEQ ID 2755 | CATCTTTACCGTCTCAGG | 1.82 |
| SEQ ID 1128 | COMP ID 1128 | TCCCTGAGACGGTAAAGA | 477 | 494 | 4423 | 4440 | SEQ ID 2756 | TCTTTACCGTCTCAGGGA | 1.56 |
| SEQ ID 1129 | COMP ID 1129 | AGTCCCTGAGACGGTAAA | 479 | 496 | 4425 | 4442 | SEQ ID 2757 | TTTACCGTCTCAGGGACT | 1.56 |
| SEQ ID 1130 | COMP ID 1130 | GAAGTCCCTGAGACGGTA | 481 | 498 | 4427 | 4444 | SEQ ID 2758 | TACCGTCTCAGGGACTTC | 1.64 |
| SEQ ID 1131 | COMP ID 1131 | TGGAAGTCCCTGAGACGG | 483 | 500 | 4429 | 4446 | SEQ ID 2759 | CCGTCTCAGGGACTTCCA | 1.43 |
| SEQ ID 1132 | COMP ID 1132 | ACTGGAAGTCCCTGAGAC | 485 | 502 | 4431 | 4448 | SEQ ID 2760 | GTCTCAGGGACTTCCAGT | 1.51 |
| SEQ ID 1133 | COMP ID 1133 | CAACTGGAAGTCCCTGAG | 487 | 504 | 4433 | 4450 | SEQ ID 2761 | CTCAGGGACTTCCAGTTG | 1.35 |
| SEQ ID 1134 | COMP ID 1134 | AGCAACTGGAAGTCCCTG | 489 | 506 | 4435 | 4452 | SEQ ID 2762 | CAGGGACTTCCAGTTGCT | 1.29 |
| SEQ ID 1135 | COMP ID 1135 | GCAGCAACTGGAAGTCCC | 491 | 508 | 4437 | 4454 | SEQ ID 2763 | GGGACTTCCAGTTGCTGC | 1.64 |
| SEQ ID 1136 | COMP ID 1136 | GGGCAGCAACTGGAAGTC | 493 | 510 | 4439 | 4456 | SEQ ID 2764 | GACTTCCAGTTGCTGCCC | 3.51 |
| SEQ ID 1137 | COMP ID 1137 | AGGGGCAGCAACTGGAAG | 495 | 512 | 4441 | 4458 | SEQ ID 2765 | CTTCCAGTTGCTGCCCCT | 2.93 |
| SEQ ID 1138 | COMP ID 1138 | GAAGGGGCAGCAACTGGA | 497 | 514 | 4443 | 4460 | SEQ ID 2766 | TCCAGTTGCTGCCCCTTC | 3.49 |
| SEQ ID 1139 | COMP ID 1139 | GGGAAGGGGCAGCAACTG | 499 | 516 | 4445 | 4462 | SEQ ID 2767 | CAGTTGCTGCCCCTTCCC | 3.34 |
| SEQ ID 1140 | COMP ID 1140 | CTGGGAAGGGGCAGCAAC | 501 | 518 | 4447 | 4464 | SEQ ID 2768 | GTTGCTGCCCCTTCCCAG | 3.12 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1141 | COMP ID 1141 | CTCTGGGAAGGGCAGCA | 503 | 520 | 4449 | 4466 | SEQ ID 2769 | TGCTGCCCCTTCCCAGAG | 2.58 |
| SEQ ID 1142 | COMP ID 1142 | ACCTCTGGGAAGGGCAG | | | 4451 | 4468 | SEQ ID 2770 | CTGCCCCTTCCCAGAGGT | 3.04 |
| SEQ ID 1143 | COMP ID 1143 | TCACCTCTGGGAAGGGC | | | 4453 | 4470 | SEQ ID 2771 | GCCCCTTCCCAGAGGTGA | 2.53 |
| SEQ ID 1144 | COMP ID 1144 | GCTCACCTCTGGGAAGG | | | 4455 | 4472 | SEQ ID 2772 | CCCTTCCCAGAGGTGAGC | 1.9 |
| SEQ ID 1145 | COMP ID 1145 | ACGCTCACCTCTGGGAAG | | | 4457 | 4474 | SEQ ID 2773 | CTTCCCAGAGGTGAGCGT | 1.37 |
| SEQ ID 1146 | COMP ID 1146 | GCACGCTCACCTCTGGGA | | | 4459 | 4476 | SEQ ID 2774 | TCCCAGAGGTGAGCGTGC | 1.82 |
| SEQ ID 1147 | COMP ID 1147 | TGGCACGCTCACCTCTGG | | | 4461 | 4478 | SEQ ID 2775 | CCAGAGGTGAGCGTGCCA | 1.43 |
| SEQ ID 1148 | COMP ID 1148 | GATGGCACGCTCACCTCT | | | 4463 | 4480 | SEQ ID 2776 | AGAGGTGAGCGTGCCATC | no data |
| SEQ ID 1149 | COMP ID 1149 | CTGATGGCACGCTCACCT | | | 4465 | 4482 | SEQ ID 2777 | AGGTGAGCGTGCCATCAG | no data |
| SEQ ID 1150 | COMP ID 1150 | GGCTGATGGCACGCTCAC | | | 4467 | 4484 | SEQ ID 2778 | GTGAGCGTGCCATCAGCC | no data |
| SEQ ID 1151 | COMP ID 1151 | TGGGCTGATGGCACGCTC | | | 4469 | 4486 | SEQ ID 2779 | GAGCGTGCCATCAGCCCA | no data |
| SEQ ID 1152 | COMP ID 1152 | ACTGGGCTGATGGCACGC | | | 4471 | 4488 | SEQ ID 2780 | GCGTGCCATCAGCCCAGT | no data |
| SEQ ID 1153 | COMP ID 1153 | CCACTGGGCTGATGGCAC | | | 4473 | 4490 | SEQ ID 2781 | GTGCCATCAGCCCAGTGG | no data |
| SEQ ID 1154 | COMP ID 1154 | CTCCACTGGGCTGATGGC | | | 4475 | 4492 | SEQ ID 2782 | GCCATCAGCCCAGTGGAG | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1155 | COMP ID 1155 | CCCTCCACTGGGCTGATG | | | 4477 | 4494 | SEQ ID 2783 | CATCAGCCCAGTGAGGG | no data |
| SEQ ID 1156 | COMP ID 1156 | GCCCCTCCACTGGGCTGA | | | 4479 | 4496 | SEQ ID 2784 | TCAGCCCAGTGGAGGGGC | no data |
| SEQ ID 1157 | COMP ID 1157 | AAGCCCCTCCACTGGGCT | | | 4481 | 4498 | SEQ ID 2785 | AGCCCAGTGGAGGGGCTT | no data |
| SEQ ID 1158 | COMP ID 1158 | CTAAGCCCCTCCACTGGG | | | 4483 | 4500 | SEQ ID 2786 | CCCAGTGGAGGGGCTTAG | no data |
| SEQ ID 1159 | COMP ID 1159 | ACCTAAGCCCCTCCACTG | | | 4485 | 4502 | SEQ ID 2787 | CAGTGGAGGGGCTTAGGT | no data |
| SEQ ID 1160 | COMP ID 1160 | AGACCTAAGCCCCTCCAC | | | 4487 | 4504 | SEQ ID 2788 | GTGGAGGGGCTTAGGTCT | no data |
| SEQ ID 1161 | COMP ID 1161 | GCAGACCTAAGCCCCTCC | | | 4489 | 4506 | SEQ ID 2789 | GGAGGGGCTTAGGTCTGC | no data |
| SEQ ID 1162 | COMP ID 1162 | ATGCAGACCTAAGCCCCT | | | 4491 | 4508 | SEQ ID 2790 | AGGGGCTTAGGTCTGCAT | no data |
| SEQ ID 1163 | COMP ID 1163 | AAATGCAGACCTAAGCCC | | | 4493 | 4510 | SEQ ID 2791 | GGGCTTAGGTCTGCATTT | no data |
| SEQ ID 1164 | COMP ID 1164 | ATAAATGCAGACCTAAGC | | | 4495 | 4512 | SEQ ID 2792 | GCTTAGGTCTGCATTTAT | no data |
| SEQ ID 1165 | COMP ID 1165 | GCATAAATGCAGACCTAA | | | 4497 | 4514 | SEQ ID 2793 | TTAGGTCTGCATTTATGC | no data |
| SEQ ID 1166 | COMP ID 1166 | AAGCATAAATGCAGACCT | | | 4499 | 4516 | SEQ ID 2794 | AGGTCTGCATTTATGCTT | no data |
| SEQ ID 1167 | COMP ID 1167 | CCCTTTTATCTGCAGGTG | | | 4531 | 4548 | SEQ ID 2795 | CACCTGCAGATAAAAGGG | no data |
| SEQ ID 1168 | COMP ID 1168 | GGCCCTTTTATCTGCAGG | | | 4533 | 4550 | SEQ ID 2796 | CCTGCAGATAAAAGGGCC | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1169 | COMP ID 1169 | AGGGCCCTTTATCTGCA | | | 4535 | 4552 | SEQ ID 2797 | TGCAGATAAAGGGCCCT | no data |
| SEQ ID 1170 | COMP ID 1170 | GCAGGGGCCCTTTATCTG | | | 4537 | 4554 | SEQ ID 2798 | CAGATAAAGGGCCCTGC | no data |
| SEQ ID 171 | COMP ID 1171 | TGGCAGGGCCCTTTATC | | | 4539 | 4556 | SEQ ID 2799 | GATAAAGGGCCCTGCCA | no data |
| SEQ ID 1172 | COMP ID 1172 | ATTGGCAGGGCCCTTTA | | | 4541 | 4558 | SEQ ID 2800 | TAAAAGGGCCCTGCCAAT | no data |
| SEQ ID 1173 | COMP ID 1173 | GCATTGGCAGGGCCCTTT | | | 4543 | 4560 | SEQ ID 2801 | AAAGGGCCCTGCCAATGC | no data |
| SEQ ID 1174 | COMP ID 1174 | CTGCATTGGCAGGGCCT | | | 4545 | 4562 | SEQ ID 2802 | AGGGCCCTGCCAATGCAG | no data |
| SEQ ID 1175 | COMP ID 1175 | ACCTGCATTGGCAGGGCC | | | 4547 | 4564 | SEQ ID 2803 | GGCCCTGCCAATGCAGGT | no data |
| SEQ ID 1176 | COMP ID 1176 | AAACCTGCATTGGCAGGG | | | 4549 | 4566 | SEQ ID 2804 | CCCTGCCAATGCAGGTTT | no data |
| SEQ ID 1177 | COMP ID 1177 | AGAAACCTGCATTGGCAG | | | 4551 | 4568 | SEQ ID 2805 | CTGCCAATGCAGGTTTCT | no data |
| SEQ ID 1178 | COMP ID 1178 | AGAGAAACCTGCATTGGC | | | 4553 | 4570 | SEQ ID 2806 | GCCAATGCAGGTTTCTCT | no data |
| SEQ ID 1179 | COMP ID 1179 | ACAGAGAAACCTGCATTG | | | 4555 | 4572 | SEQ ID 2807 | CAATGCAGGTTTCTCTGT | no data |
| SEQ ID 1180 | COMP ID 1180 | ACACAGAGAAACCTGCAT | | | 4557 | 4574 | SEQ ID 2808 | ATGCAGGTTTCTCTGTGT | no data |
| SEQ ID 1181 | COMP ID 1181 | GAACACAGAGAAACCTGC | | | 4559 | 4576 | SEQ ID 2809 | GCAGGTTTCTCTGTGTTC | no data |
| SEQ ID 1182 | COMP ID 1182 | TGGAACACAGAGAAACCT | | | 4561 | 4578 | SEQ ID 2810 | AGGTTTCTCTGTGTTCCA | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1183 | COMP ID 1183 | TGTGGAACACAGAGAAAC | | | 4563 | 4580 | SEQ ID 2811 | GTTTCTCTGTGTTCCACA | no data |
| SEQ ID 1184 | COMP ID 1184 | CCTGTGGAACACAGAGAA | | | 4565 | 4582 | SEQ ID 2812 | TTCTCTGTGTTCCACAGG | no data |
| SEQ ID 1185 | COMP ID 1185 | GGCCTGTGGAACACAGAG | | | 4567 | 4584 | SEQ ID 2813 | CTCTGTGTTCCACAGGCC | no data |
| SEQ ID 1186 | COMP ID 1186 | ACGGCCTGTGGAACACAG | | | 4569 | 4586 | SEQ ID 2814 | CTGTGTTCCACAGGCCGT | no data |
| SEQ ID 1187 | COMP ID 1187 | CCACGGCCTGTGGAACAC | | | 4571 | 4588 | SEQ ID 2815 | GTGTTCCACAGGCCGTGG | 1.25 |
| SEQ ID 1188 | COMP ID 1188 | TGCCACGGCCTGTGGAAC | | | 4573 | 4590 | SEQ ID 2816 | GTTCCACAGGCCGTGGCA | 1.69 |
| SEQ ID 1189 | COMP ID 1189 | CATGCCACGGCCTGTGGA | | | 4575 | 4592 | SEQ ID 2817 | TCCACAGGCCGTGGCATG | 1.65 |
| SEQ ID 1190 | COMP ID 1190 | CGCATGCCACGGCCTGTG | | | 4577 | 4594 | SEQ ID 2818 | CACAGGCCGTGGCATGCG | 1.91 |
| SEQ ID 1191 | COMP ID 1191 | CCCGCATGCCACGGCCTG | | | 4579 | 4596 | SEQ ID 2819 | CAGGCCGTGGCATGCGGG | 1.81 |
| SEQ ID 1192 | COMP ID 1192 | TCCCCGCATGCCACGGCC | 520 | 537 | 4581 | 4598 | SEQ ID 2820 | GGCCGTGGCATGCGGGGA | 1.63 |
| SEQ ID 1193 | COMP ID 1193 | CATCCCCGCATGCCACGG | 522 | 539 | 4583 | 4600 | SEQ ID 2821 | CCGTGGCATGCGGGGATG | 1.05 |
| SEQ ID 1194 | COMP ID 1194 | GCCATCCCCGCATGCCAC | 524 | 541 | 4585 | 4602 | SEQ ID 2822 | GTGGCATGCGGGGATGGC | 1.05 |
| SEQ ID 1195 | COMP ID 1195 | TGGCCATCCCCGCATGCC | 526 | 543 | 4587 | 4604 | SEQ ID 2823 | GGCATGCGGGGATGGCCA | 1.37 |
| SEQ ID 1196 | COMP ID 1196 | GATGGCCATCCCCGCATG | 528 | 545 | 4589 | 4606 | SEQ ID 2824 | CATGCGGGGATGGCCATC | 1.58 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every $2^{nd}$ or $3^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1197 | COMP ID 1197 | GTGATGGCCATCCCCGCA | 530 | 547 | 4591 | 4608 | SEQ ID 2825 | TGCGGGGATGGCCATCAC | 1.23 |
| SEQ ID 1198 | COMP ID 1198 | CAGTGATGGCCATCCCCG | 532 | 549 | 4593 | 4610 | SEQ ID 2826 | CGGGGATGGCCATCACTG | 1.46 |
| SEQ ID 1199 | COMP ID 1199 | AGCAGTGATGGCCATCCC | 534 | 551 | 4595 | 4612 | SEQ ID 2827 | GGGATGGCCATCACTGCT | 1.3 |
| SEQ ID 1200 | COMP ID 1200 | GCAGCAGTGATGGCCATC | 536 | 553 | 4597 | 4614 | SEQ ID 2828 | GATGCCATCACTGCTGC | 2.46 |
| SEQ ID 1201 | COMP ID 1201 | GGGCAGCAGTGATGGCCA | 538 | 555 | 4599 | 4616 | SEQ ID 2829 | TGGCCATCACTGCTGCCC | 1.74 |
| SEQ ID 1202 | COMP ID 1202 | GTGGGCAGCAGTGATGGC | 540 | 557 | 4601 | 4618 | SEQ ID 2830 | GCCATCACTGCTGCCCAC | 1.59 |
| SEQ ID 1203 | COMP ID 1203 | CCGTGGGCAGCAGTGATG | 542 | 559 | 4603 | 4620 | SEQ ID 2831 | CATCACTGCTGCCCACGG | 1.66 |
| SEQ ID 1204 | COMP ID 1204 | CCCCGTGGGCAGCAGTGA | 544 | 561 | 4605 | 4622 | SEQ ID 2832 | TCACTGCTGCCCACGGGG | 1.52 |
| SEQ ID 1205 | COMP ID 1205 | AGCCCCGTGGGCAGCAGT | 546 | 563 | 4607 | 4624 | SEQ ID 2833 | ACTGCTGCCCACGGGGCT | 1.53 |
| SEQ ID 1206 | COMP ID 1206 | GAAGCCCCGTGGGCAGCA | 548 | 565 | 4609 | 4626 | SEQ ID 2834 | TGCTGCCCACGGGGCTTC | 1.66 |
| SEQ ID 1207 | COMP ID 1207 | TGGAAGCCCCGTGGGCAG | 550 | 567 | 4611 | 4628 | SEQ ID 2835 | CTGCCCACGGGGCTTCCA | 2.45 |
| SEQ ID 1208 | COMP ID 1208 | AGTGGAAGCCCCGTGGGC | 552 | 569 | 4613 | 4630 | SEQ ID 2836 | GCCACGGGGCTTCCACT | 1.72 |
| SEQ ID 1209 | COMP ID 1209 | GCAGTGGAAGCCCCGTGG | 554 | 571 | 4615 | 4632 | SEQ ID 2837 | CCACGGGGCTTCCACTGC | 1.98 |
| SEQ ID 1210 | COMP ID 1210 | CTGCAGTGGAAGCCCCGT | 556 | 573 | 4617 | 4634 | SEQ ID 2838 | ACGGGGCTTCCACTGCAG | 1.48 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1211 | COMP ID 1211 | CACTGCAGTGGAAGCCCC | 558 | 575 | 4619 | 4636 | SEQ ID 2839 | GGGGCTTCCACTGCAGTG | 1.31 |
| SEQ ID 1212 | COMP ID 1212 | TGCACTGCAGTGGAAGCC | 560 | 577 | 4621 | 4638 | SEQ ID 2840 | GGCTTCCACTGCAGTGCA | 1.42 |
| SEQ ID 1213 | COMP ID 1213 | TCTGCACTGCAGTGGAAG | 562 | 579 | 4623 | 4640 | SEQ ID 2841 | CTTCCACTGCAGTGCAGA | 1.3 |
| SEQ ID 1214 | COMP ID 1214 | CGTCTGCACTGCAGTGGA | 564 | 581 | 4625 | 4642 | SEQ ID 2842 | TCCACTGCAGTGCAGACG | 1.35 |
| SEQ ID 1215 | COMP ID 1215 | CCCGTCTGCACTGCAGTG | 566 | 583 | 4627 | 4644 | SEQ ID 2843 | CACTGCAGTGCAGACGGG | 1.12 |
| SEQ ID 1216 | COMP ID 1216 | CGCCCGTCTGCACTGCAG | 568 | 585 | 4629 | 4646 | SEQ ID 2844 | CTGCAGTGCAGACGGGCG | 1.03 |
| SEQ ID 1217 | COMP ID 1217 | ATCGCCCGTCTGCACTGC | 570 | 587 | 4631 | 4648 | SEQ ID 2845 | GCAGTGCAGACGGGCGAT | 1.05 |
| SEQ ID 1218 | COMP ID 1218 | GGATCGCCCGTCTGCACT | 572 | 589 | 4633 | 4650 | SEQ ID 2846 | AGTGCAGACGGGCGATCC | 0.93 |
| SEQ ID 1219 | COMP ID 1219 | CAGGATCGCCCGTCTGCA | 574 | 591 | 4635 | 4652 | SEQ ID 2847 | TGCAGACGGGCGATCCTG | 1.17 |
| SEQ ID 1220 | COMP ID 1220 | AGCAGGATCGCCCGTCTG | 576 | 593 | 4637 | 4654 | SEQ ID 2848 | CAGACGGGCGATCCTGCT | 1.2 |
| SEQ ID 1221 | COMP ID 1221 | GAAGCAGGATCGCCCGTC | 578 | 595 | 4639 | 4656 | SEQ ID 2849 | GACGGGCGATCCTGCTTC | 1.4 |
| SEQ ID 1222 | COMP ID 1222 | TGGAAGCAGGATCGCCCG | 580 | 597 | 4641 | 4658 | SEQ ID 2850 | CGGGCGATCCTGCTTCCA | 1.46 |
| SEQ ID 1223 | COMP ID 1223 | TTTGGAAGCAGGATCGCC | 582 | 599 | 4643 | 4660 | SEQ ID 2851 | GGCGATCCTGCTTCCAAA | 1.55 |
| SEQ ID 1224 | COMP ID 1224 | TCTTTGGAAGCAGGATCG | 584 | 601 | 4645 | 4662 | SEQ ID 2852 | CGATCCTGCTTCCAAAGA | 1.62 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1225 | COMP ID 1225 | GATCTTTGGAAGCAGGAT | 586 | 603 | 4647 | 4664 | SEQ ID 2853 | ATCCTGCTTCCAAAGATC | 1.44 |
| SEQ ID 1226 | COMP ID 1226 | CTGATCTTTGGAAGCAGG | 588 | 605 | 4649 | 4666 | SEQ ID 2854 | CCTGCTTCCAAAGATCAG | 1.13 |
| SEQ ID 1227 | COMP ID 1227 | ACCCACACCCCAGCTGCA | | | 4668 | 4685 | SEQ ID 2855 | TGCAGCTGGGGTGTGGGT | 1.22 |
| SEQ ID 1228 | COMP ID 1228 | GCACCCACACCCCAGCTG | | | 4670 | 4687 | SEQ ID 2856 | CAGCTGGGGTGTGTGGGTGC | 0.93 |
| SEQ ID 1229 | COMP ID 1229 | CTGCACCCACACCCCAGC | | | 4672 | 4689 | SEQ ID 2857 | GCTGGGGTGTGGGTGCAG | 0.89 |
| SEQ ID 1230 | COMP ID 1230 | CCCTGCACCCACACCCCA | | | 4674 | 4691 | SEQ ID 2858 | TGGGGTGTGGGTGCAGGG | 1.04 |
| SEQ ID 1231 | COMP ID 1231 | TGCCCTGCACCCACACCC | | | 4676 | 4693 | SEQ ID 2859 | GGGTGTGGGTGCAGGGCA | 1.04 |
| SEQ ID 1232 | COMP ID 1232 | CCTGCCCTGCACCCACAC | | | 4678 | 4695 | SEQ ID 2860 | GTGTGGGTGCAGGGCAGG | 1.22 |
| SEQ ID 1233 | COMP ID 1233 | TGCCTGCCCTGCACCCAC | | | 4680 | 4697 | SEQ ID 2861 | GTGGGTGCAGGGCAGGCA | 1.14 |
| SEQ ID 1234 | COMP ID 1234 | TCTGCCTGCCCTGCACCC | | | 4682 | 4699 | SEQ ID 2862 | GGGTGCAGGGCAGGCAGA | 1.19 |
| SEQ ID 1235 | COMP ID 1235 | CGTCTGCCTGCCCTGCAC | | | 4684 | 4701 | SEQ ID 2863 | GTGCAGGGCAGGCAGACG | 1.42 |
| SEQ ID 1236 | COMP ID 1236 | CCCGTCTGCCTGCCCTGC | | | 4686 | 4703 | SEQ ID 2864 | GCAGGGCAGGCAGACGGG | 1.09 |
| SEQ ID 1237 | COMP ID 1237 | TGCCCGTCTGCCTGCCCT | | | 4688 | 4705 | SEQ ID 2865 | AGGGCAGGCAGACGGGCA | 1.27 |
| SEQ ID 1238 | COMP ID 1238 | GCTGCCCGTCTGCCTGCC | | | 4690 | 4707 | SEQ ID 2866 | GGCAGGCAGACGGGCAGC | 1.56 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | End Position | Precursor-mRNA Position (SEQ ID NO 3949) Start Position | End Position | Target Site Sequence ID | Target Site Sequence | Relative Progranulin expression (Relative to PBS) |
|---|---|---|---|---|---|---|---|---|---|
| SEQ ID 1239 | COMP ID 1239 | ATGCTGCCCGTCTGCCTG | | | 4692 | 4709 | SEQ ID 2867 | CAGGCAGACGGGCAGCAT | 1.38 |
| SEQ ID 1240 | COMP ID 1240 | CCACATGCTGCCCGTCTG | | | 4696 | 4713 | SEQ ID 2868 | CAGACGGGCAGCATGTGG | 1.1 |
| SEQ ID 1241 | COMP ID 1241 | CTCCACATGCTGCCCGTC | | | 4698 | 4715 | SEQ ID 2869 | GACGGGCAGCATGTGGAG | 1.18 |
| SEQ ID 1242 | COMP ID 1242 | GACTCCACATGCTGCCCG | | | 4700 | 4717 | SEQ ID 2870 | CGGGCAGCATGTGGAGTC | 1.42 |
| SEQ ID 1243 | COMP ID 1243 | CCACTCAGGGAAGGTGAC | | | 5093 | 5110 | SEQ ID 2871 | GTCACCTTCCCTGAGTGG | 1.78 |
| SEQ ID 1244 | COMP ID 1244 | GCCCACTCAGGGAAGGTG | | | 5095 | 5112 | SEQ ID 2872 | CACCTTCCCTGAGTGGGC | 1.68 |
| SEQ ID 1245 | COMP ID 1245 | CAGCCCACTCAGGGAAGG | | | 5097 | 5114 | SEQ ID 2873 | CCTTCCCTGAGTGGGCTG | 1.15 |
| SEQ ID 1246 | COMP ID 1246 | ACCAGCCCACTCAGGGAA | | | 5099 | 5116 | SEQ ID 2874 | TTCCCTGAGTGGGCTGGT | 1 |
| SEQ ID 1247 | COMP ID 1247 | CTACCAGCCCACTCAGGG | | | 5101 | 5118 | SEQ ID 2875 | CCCTGAGTGGGCTGGTAG | 1.14 |
| SEQ ID 1248 | COMP ID 1248 | TACTACCAGCCCACTCAG | | | 5103 | 5120 | SEQ ID 2876 | CTGAGTGGGCTGGTAGTA | 1.14 |
| SEQ ID 1249 | COMP ID 1249 | GATACTACCAGCCCACTC | | | 5105 | 5122 | SEQ ID 2877 | GAGTGGGCTGGTAGTATC | no data |
| SEQ ID 1250 | COMP ID 1250 | AGGATACTACCAGCCCAC | | | 5107 | 5124 | SEQ ID 2878 | GTGGGCTGGTAGTATCCT | 1.23 |
| SEQ ID 1251 | COMP ID 1251 | CCAGGATACTACCAGCCC | | | 5109 | 5126 | SEQ ID 2879 | GGGCTGGTAGTATCCTGG | 1.2 |
| SEQ ID 1252 | COMP ID 1252 | ACCCAGGATACTACCAGC | | | 5111 | 5128 | SEQ ID 2880 | GCTGGTAGTATCCTGGGT | 1.08 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1253 | COMP ID 1253 | TGACCCAGGATACTACCA | | | 5113 | 5130 | SEQ ID 2881 | TGGTAGTATCCTGGGTCA | 1.16 |
| SEQ ID 1254 | COMP ID 1254 | GATGACCCAGGATACTAC | | | 5115 | 5132 | SEQ ID 2882 | GTAGTATCCTGGGTCATC | 1.26 |
| SEQ ID 1255 | COMP ID 1255 | AAGATGACCCAGGATACT | | | 5117 | 5134 | SEQ ID 2883 | AGTATCCTGGGTCATCTT | 1.16 |
| SEQ ID 1256 | COMP ID 1256 | ACAAGATGACCCAGGATA | | | 5119 | 5136 | SEQ ID 2884 | TATCCTGGGTCATCTTGT | 1.17 |
| SEQ ID 1257 | COMP ID 1257 | GGACAAGATGACCCAGGA | | | 5121 | 5138 | SEQ ID 2885 | TCCTGGGTCATCTTGTCC | 1.3 |
| SEQ ID 1258 | COMP ID 1258 | GTGGACAAGATGACCCAG | | | 5123 | 5140 | SEQ ID 2886 | CTGGGTCATCTTGTCCAC | 1.5 |
| SEQ ID 1259 | COMP ID 1259 | CTGTGGACAAGATGACCC | | | 5125 | 5142 | SEQ ID 2887 | GGGTCATCTTGTCCACAG | 1.6 |
| SEQ ID 1260 | COMP ID 1260 | ACCTGTGGACAAGATGAC | | | 5127 | 5144 | SEQ ID 2888 | GTCATCTTGTCCACAGGT | 1.21 |
| SEQ ID 1261 | COMP ID 1261 | TTACCTGTGGACAAGATG | | | 5129 | 5146 | SEQ ID 2889 | CATCTTGTCCACAGGTAA | 1.22 |
| SEQ ID 1262 | COMP ID 1262 | TGTTACCTGTGGACAAGA | | | 5131 | 5148 | SEQ ID 2890 | TCTTGTCCACAGGTAACA | 1.69 |
| SEQ ID 1263 | COMP ID 1263 | GTTGTTACCTGTGGACAA | | | 5133 | 5150 | SEQ ID 2891 | TTGTCCACAGGTAACAAC | 1.6 |
| SEQ ID 1264 | COMP ID 1264 | GAGTTGTTACCTGTGGAC | | | 5135 | 5152 | SEQ ID 2892 | GTCCACAGGTAACAACTC | 1.93 |
| SEQ ID 1265 | COMP ID 1265 | CGGAGTTGTTACCTGTGG | | | 5137 | 5154 | SEQ ID 2893 | CCACAGGTAACAACTCCG | 1.48 |
| SEQ ID 1266 | COMP ID 1266 | CACGGAGTTGTTACCTGT | | | 5139 | 5156 | SEQ ID 2894 | ACAGGTAACAACTCCGTG | 1.41 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion End Position | Precursor-mRNA Position (SEQ ID NO 3949) Start Position | Precursor-mRNA Position End Position | Target Site Sequence ID | Target Site Sequence | Relative Progranulin expression (Relative to PBS) |
|---|---|---|---|---|---|---|---|---|---|
| SEQ ID 1267 | COMP ID 1267 | CCCACGGAGTTGTTACCT | 604 | 621 | 5141 | 5158 | SEQ ID 2895 | AGGTAACAACTCCGTGGG | 1.52 |
| SEQ ID 1268 | COMP ID 1268 | CACCCACGGAGTTGTTAC | 606 | 623 | 5143 | 5160 | SEQ ID 2896 | GTAACAACTCCGTGGGTG | 1.74 |
| SEQ ID 1269 | COMP ID 1269 | GGCACCCACGGAGTTGTT | 608 | 625 | 5145 | 5162 | SEQ ID 2897 | AACAACTCCGTGGGTGCC | 1.22 |
| SEQ ID 1270 | COMP ID 1270 | ATGGCACCCACGGAGTTG | 610 | 627 | 5147 | 5164 | SEQ ID 2898 | CAACTCCGTGGGTGCCAT | 1.21 |
| SEQ ID 1271 | COMP ID 1271 | GGATGGCACCCACGGAGT | 612 | 629 | 5149 | 5166 | SEQ ID 2899 | ACTCCGTGGGTGCCATCC | 1.9 |
| SEQ ID 1272 | COMP ID 1272 | CTGGATGGCACCCACGGA | 614 | 631 | 5151 | 5168 | SEQ ID 2900 | TCCGTGGGTGCCATCCAG | 1.3 |
| SEQ ID 1273 | COMP ID 1273 | CACTGGATGGCACCCACG | 616 | 633 | 5153 | 5170 | SEQ ID 2901 | CGTGGGTGCCATCCAGTG | 1.16 |
| SEQ ID 1274 | COMP ID 1274 | GGCACTGGATGGCACCCA | 618 | 635 | 5155 | 5172 | SEQ ID 2902 | TGGGTGCCATCCAGTGCC | 1.31 |
| SEQ ID 1275 | COMP ID 1275 | AGGGCACTGGATGGCACC | 620 | 637 | 5157 | 5174 | SEQ ID 2903 | GGTGCCATCCAGTGCCCT | 1.49 |
| SEQ ID 1276 | COMP ID 1276 | TCAGGGCACTGGATGGCA | 622 | 639 | 5159 | 5176 | SEQ ID 2904 | TGCCATCCAGTGCCCTGA | 1.7 |
| SEQ ID 1277 | COMP ID 1277 | TATCAGGGCACTGGATGG | 624 | 641 | 5161 | 5178 | SEQ ID 2905 | CCATCCAGTGCCCTGATA | 1.04 |
| SEQ ID 1278 | COMP ID 1278 | ACTATCAGGGCACTGGAT | 626 | 643 | 5163 | 5180 | SEQ ID 2906 | ATCCAGTGCCCTGATAGT | 1.19 |
| SEQ ID 1279 | COMP ID 1279 | TGACTATCAGGGCACTGG | 628 | 645 | 5165 | 5182 | SEQ ID 2907 | CCAGTGCCCTGATAGTCA | 1.18 |
| SEQ ID 1280 | COMP ID 1280 | ACTGACTATCAGGGCACT | 630 | 647 | 5167 | 5184 | SEQ ID 2908 | AGTGCCCTGATAGTCAGT | 1.04 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) Position End | Target Site Sequence ID | Target Site Sequence | Relative Progranulin expression (Relative to PBS) |
|---|---|---|---|---|---|---|---|---|---|
| SEQ ID 1281 | COMP ID 1281 | GAACTGACTATCAGGGCA | 632 | 649 | 5169 | 5186 | SEQ ID 2909 | TGCCCTGATAGTCAGTTC | 1.08 |
| SEQ ID 1282 | COMP ID 1282 | TCGAACTGACTATCAGGG | 634 | 651 | 5171 | 5188 | SEQ ID 2910 | CCCTGATAGTCAGTTCGA | 1.59 |
| SEQ ID 1283 | COMP ID 1283 | ATTCGAACTGACTATCAG | 636 | 653 | 5173 | 5190 | SEQ ID 2911 | CTGATAGTCAGTTCGAAT | 1.64 |
| SEQ ID 1284 | COMP ID 1284 | GCATTCGAACTGACTATC | 638 | 655 | 5175 | 5192 | SEQ ID 2912 | GATAGTCAGTTCGAATGC | 1.67 |
| SEQ ID 1285 | COMP ID 1285 | GGGCATTCGAACTGACTA | 640 | 657 | 5177 | 5194 | SEQ ID 2913 | TAGTCAGTTCGAATGCCC | 1.55 |
| SEQ ID 1286 | COMP ID 1286 | CCGGGCATTCGAACTGAC | 642 | 659 | 5179 | 5196 | SEQ ID 2914 | GTCAGTTCGAATGCCCGG | 1.81 |
| SEQ ID 1287 | COMP ID 1287 | GTCCGGGCATTCGAACTG | 644 | 661 | 5181 | 5198 | SEQ ID 2915 | CAGTTCGAATGCCCGGAC | 1.09 |
| SEQ ID 1288 | COMP ID 1288 | AAGTCCGGGCATTCGAAC | 646 | 663 | 5183 | 5200 | SEQ ID 2916 | GTTCGAATGCCCGGACTT | 1.62 |
| SEQ ID 1289 | COMP ID 1289 | AGAAGTCCGGGCATTCGA | 648 | 665 | 5185 | 5202 | SEQ ID 2917 | TCGAATGCCCGGACTTCT | 1.48 |
| SEQ ID 1290 | COMP ID 1290 | GGAGAAGTCCGGGCATTC | 650 | 667 | 5187 | 5204 | SEQ ID 2918 | GAATGCCCGGACTTCTCC | 1.8 |
| SEQ ID 1291 | COMP ID 1291 | GTGGAGAAGTCCGGGCAT | 652 | 669 | 5189 | 5206 | SEQ ID 2919 | ATGCCCGGACTTCTCCAC | 2.43 |
| SEQ ID 1292 | COMP ID 1292 | ACGTGGAGAAGTCCGGGC | 654 | 671 | 5191 | 5208 | SEQ ID 2920 | GCCCGGACTTCTCCACGT | 1.93 |
| SEQ ID 1293 | COMP ID 1293 | GCACGTGGAGAAGTCCGG | 656 | 673 | 5193 | 5210 | SEQ ID 2921 | CCGGACTTCTCCACGTGC | 1.44 |
| SEQ ID 1294 | COMP ID 1294 | CAGCACGTGGAGAAGTCC | 658 | 675 | 5195 | 5212 | SEQ ID 2922 | GGACTTCTCCACGTGCTG | 1.71 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1295 | COMP ID 1295 | CACAGCACGTGGAGAAGT | 660 | 677 | 5197 | 5214 | SEQ ID 2923 | ACTTCTCCACGTGCTGTG | 1.2 |
| SEQ ID 1296 | COMP ID 1296 | AACACAGCACGTGGAGAA | 662 | 679 | 5199 | 5216 | SEQ ID 2924 | TTCTCCACGTGCTGTGTT | 1.39 |
| SEQ ID 1297 | COMP ID 1297 | ATAACACAGCACGTGGAG | 664 | 681 | 5201 | 5218 | SEQ ID 2925 | CTCCACGTGCTGTGTTAT | 1.51 |
| SEQ ID 1298 | COMP ID 1298 | CCATAACACAGCACGTGG | 666 | 683 | 5203 | 5220 | SEQ ID 2926 | CCACGTGCTGTGTTATGG | 1.78 |
| SEQ ID 1299 | COMP ID 1299 | GACCATAACACAGCACGT | 668 | 685 | 5205 | 5222 | SEQ ID 2927 | ACGTGCTGTGTTATGGTC | 1.22 |
| SEQ ID 1300 | COMP ID 1300 | TCGACCATAACACAGCAC | 670 | 687 | 5207 | 5224 | SEQ ID 2928 | GTGCTGTGTTATGGTCGA | 1.16 |
| SEQ ID 1301 | COMP ID 1301 | CATCGACCATAACACAGC | 672 | 689 | 5209 | 5226 | SEQ ID 2929 | GCTGTGTTATGGTCGATG | 1.06 |
| SEQ ID 1302 | COMP ID 1302 | GCCATCGACCATAACACA | 674 | 691 | 5211 | 5228 | SEQ ID 2930 | TGTGTTATGGTCGATGGC | 1.14 |
| SEQ ID 1303 | COMP ID 1303 | GAGCCATCGACCATAACA | 676 | 693 | 5213 | 5230 | SEQ ID 2931 | TGTTATGGTCGATGGCTC | 1.29 |
| SEQ ID 1304 | COMP ID 1304 | AGGAGCCATCGACCATAA | 678 | 695 | 5215 | 5232 | SEQ ID 2932 | TTATGGTCGATGGCTCCT | 1.52 |
| SEQ ID 1305 | COMP ID 1305 | CCAGGAGCCATCGACCAT | 680 | 697 | 5217 | 5234 | SEQ ID 2933 | ATGGTCGATGGCTCCTGG | 0.81 |
| SEQ ID 1306 | COMP ID 1306 | CCCCAGGAGCCATCGACC | 682 | 699 | 5219 | 5236 | SEQ ID 2934 | GGTCGATGGCTCCTGGGG | 1.3 |
| SEQ ID 1307 | COMP ID 1307 | ACCCCCAGGAGCCATCGA | 684 | 701 | 5221 | 5238 | SEQ ID 2935 | TCGATGGCTCCTGGGGGT | 1.46 |
| SEQ ID 1308 | COMP ID 1308 | GCACCCCAGGAGCCATC | 686 | 703 | 5223 | 5240 | SEQ ID 2936 | GATGGCTCCTGGGGGTGC | 1.19 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) Position End | Target Site Sequence ID | Target Site Sequence | Relative Progranulin expression (Relative to PBS) |
|---|---|---|---|---|---|---|---|---|---|
| SEQ ID 1309 | COMP ID 1309 | CAGCACCCCAGGAGCCA | 688 | 705 | 5225 | 5242 | SEQ ID 2937 | TGGCTCCTCGGGGTGCTG | 1.2 |
| SEQ ID 1310 | COMP ID 1310 | GGCAGCACCCCAGGAGC | 690 | 707 | 5227 | 5244 | SEQ ID 2938 | GCTCCTGGGGTGCTGCCC | 1.22 |
| SEQ ID 1311 | COMP ID 1311 | GGGGCAGCACCCCAGGA | 692 | 709 | 5229 | 5246 | SEQ ID 2939 | TCCTGGGGTGCTGCCCC | 1.61 |
| SEQ ID 1312 | COMP ID 1312 | ATGGGGCAGCACCCCCAG | 694 | 711 | 5231 | 5248 | SEQ ID 2940 | CTGGGGTGCTGCCCCAT | 1.3 |
| SEQ ID 1313 | COMP ID 1313 | GCATGGGGCAGCACCCC | 696 | 713 | 5233 | 5250 | SEQ ID 2941 | GGGGTGCTGCCCCATGC | 1.9 |
| SEQ ID 1314 | COMP ID 1314 | GGGCATGGGGCAGCACCC | 698 | 715 | 5235 | 5252 | SEQ ID 2942 | GGGTGCTGCCCCATGCCC | 2.75 |
| SEQ ID 1315 | COMP ID 1315 | TGGGGCATGGGGCAGCAC | 700 | 717 | 5237 | 5254 | SEQ ID 2943 | GTGCTGCCCCATGCCCCA | 2.3 |
| SEQ ID 1316 | COMP ID 1316 | TCTCCCCAGATTTGTAC | | | 5256 | 5273 | SEQ ID 2944 | GTACAAATCTGGGGAGA | 1.34 |
| SEQ ID 1317 | COMP ID 1317 | CATCTCCCCAGATTTGT | | | 5258 | 5275 | SEQ ID 2945 | ACAAATCTGGGGAGATG | 1.28 |
| SEQ ID 1318 | COMP ID 1318 | CCCATCTCCCCAGATTT | | | 5260 | 5277 | SEQ ID 2946 | AAATCTGGGGAGATGGG | 1.33 |
| SEQ ID 1319 | COMP ID 1319 | CCCCATCTCCCCAGAT | | | 5262 | 5279 | SEQ ID 2947 | ATCTGGGGAGATGGGGG | 1.32 |
| SEQ ID 1320 | COMP ID 1320 | TACCCCATCTCCCCCAG | | | 5264 | 5281 | SEQ ID 2948 | CTGGGGAGATGGGGGTA | 1.04 |
| SEQ ID 1321 | COMP ID 1321 | CATACCCCATCTCCCCC | | | 5266 | 5283 | SEQ ID 2949 | GGGGAGATGGGGGTATG | 1.02 |
| SEQ ID 1322 | COMP ID 1322 | CACATACCCCATCTCCC | | | 5268 | 5285 | SEQ ID 2950 | GGGAGATGGGGTATGTG | 1.05 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1323 | COMP ID 1323 | TCCACATACCCCATCTC | | | 5270 | 5287 | SEQ ID 2951 | GAGATGGGGTATGTGGA | 1.05 |
| SEQ ID 1324 | COMP ID 1324 | CCTCCACATACCCCATC | | | 5272 | 5289 | SEQ ID 2952 | GATGGGGTATGTGGAGG | 0.77 |
| SEQ ID 1325 | COMP ID 1325 | TCCCTCCACATACCCCA | | | 5274 | 5291 | SEQ ID 2953 | TGGGGTATGTGGAGGGA | 1.25 |
| SEQ ID 1326 | COMP ID 1326 | CTTCCCTCCACATACCC | | | 5276 | 5293 | SEQ ID 2954 | GGGTATGTGGAGGGAAG | 1.03 |
| SEQ ID 1327 | COMP ID 1327 | CACTTCCCTCCACATACC | | | 5278 | 5295 | SEQ ID 2955 | GGTATGTGGAGGGAAGTG | 1.29 |
| SEQ ID 1328 | COMP ID 1328 | CCCACTTCCCTCCACATA | | | 5280 | 5297 | SEQ ID 2956 | TATGTGGAGGGAAGTGGG | 1.07 |
| SEQ ID 1329 | COMP ID 1329 | CCCCCACTTCCCTCCACA | | | 5282 | 5299 | SEQ ID 2957 | TGTGGAGGGAAGTGGGGG | 1.21 |
| SEQ ID 1330 | COMP ID 1330 | TGCCCCACTTCCCTCCA | | | 5284 | 5301 | SEQ ID 2958 | TGGAGGGAAGTGGGGCA | 1.12 |
| SEQ ID 1331 | COMP ID 1331 | TCTGCCCCACTTCCCTC | | | 5286 | 5303 | SEQ ID 2959 | GAGGGAAGTGGGGCAGA | 0.97 |
| SEQ ID 1332 | COMP ID 1332 | ACTCTGCCCCACTTCCC | | | 5288 | 5305 | SEQ ID 2960 | GGGAAGTGGGGCAGAGT | 1.08 |
| SEQ ID 1333 | COMP ID 1333 | CCCTGCCCCTGGCCCCA | | | 5306 | 5323 | SEQ ID 2961 | TGGGGCCAGGGGCAGGG | 1.31 |
| SEQ ID 1334 | COMP ID 1334 | CCCCCTGCCCCTGGCCC | | | 5308 | 5325 | SEQ ID 2962 | GGGCCAGGGGCAGGGGG | 0.97 |
| SEQ ID 1335 | COMP ID 1335 | CACCCCCTGCCCCTGGCC | | | 5310 | 5327 | SEQ ID 2963 | GGCCAGGGGCAGGGGTG | 1.29 |
| SEQ ID 1336 | COMP ID 1336 | TTCACCCCCTGCCCCTGG | | | 5312 | 5329 | SEQ ID 2964 | CCAGGGGCAGGGGTGAA | 1.28 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | End Position | Precursor-mRNA Position (SEQ ID NO 3949) Start Position | Position End | Target Site Sequence ID | Target Site Sequence | Relative Progranulin expression (Relative to PBS) |
|---|---|---|---|---|---|---|---|---|---|
| SEQ ID 1337 | COMP ID 1337 | TCTTCACCCCCTGCCCT | | | 5314 | 5331 | SEQ ID 2965 | AGGGCAGGGGGTGAAGA | 1.07 |
| SEQ ID 1338 | COMP ID 1338 | CGTCTTCACCCCCTGCCC | | | 5316 | 5333 | SEQ ID 2966 | GGGCAGGGGGTGAAGACG | 1.05 |
| SEQ ID 1339 | COMP ID 1339 | TCCGTCTTCACCCCCTGC | | | 5318 | 5335 | SEQ ID 2967 | GCAGGGGGTGAAGACGGA | 1 |
| SEQ ID 1340 | COMP ID 1340 | ACTCCGTCTTCACCCCCT | | | 5320 | 5337 | SEQ ID 2968 | AGGGGGTGAAGACGGAGT | no data |
| SEQ ID 1341 | COMP ID 1341 | TGACTCCGTCTTCACCCC | | | 5322 | 5339 | SEQ ID 2969 | GGGTGAAGACGGAGTCA | 1.14 |
| SEQ ID 1342 | COMP ID 1342 | CCTGACTCCGTCTTCACC | | | 5324 | 5341 | SEQ ID 2970 | GGTGAAGACGGAGTCAGG | 1.14 |
| SEQ ID 1343 | COMP ID 1343 | GTCCTGACTCCGTCTTCA | | | 5326 | 5343 | SEQ ID 2971 | TGAAGACGGAGTCAGGAC | 1.38 |
| SEQ ID 1344 | COMP ID 1344 | TGGTCCTGACTCCGTCTT | | | 5328 | 5345 | SEQ ID 2972 | AAGACGGAGTCAGGACCA | 1.57 |
| SEQ ID 1345 | COMP ID 1345 | AATGGTCCTGACTCCGTC | | | 5330 | 5347 | SEQ ID 2973 | GACCGAGTCAGGACCATT | 2.04 |
| SEQ ID 1346 | COMP ID 1346 | AAAATGGTCCTGACTCCG | | | 5332 | 5349 | SEQ ID 2974 | CGGAGTCAGGACCATTTT | 2.27 |
| SEQ ID 1347 | COMP ID 1347 | AAAAAATGGTCCTGACTC | | | 5334 | 5351 | SEQ ID 2975 | GAGTCAGGACCATTTTTT | 1.83 |
| SEQ ID 1348 | COMP ID 1348 | AGAAAAATGGTCCTGAC | | | 5336 | 5353 | SEQ ID 2976 | GTCAGGACCATTTTTTCT | 1.71 |
| SEQ ID 1349 | COMP ID 1349 | TGAGAAAAATGGTCCTG | | | 5338 | 5355 | SEQ ID 2977 | CAGGACCATTTTTTCTCA | 2.21 |
| SEQ ID 1350 | COMP ID 1350 | GTCTTCACGCAGGAAGC | 719 | 736 | 5357 | 5374 | SEQ ID 2978 | GCTTCCTGCTGTGAAGAC | 1.33 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1351 | COMP ID 1351 | CTGTCTTCACAGCAGGAA | 721 | 738 | 5359 | 5376 | SEQ ID 2979 | TTCCTGCTGTGAAGACAG | 1.49 |
| SEQ ID 1352 | COMP ID 1352 | CCCTGTCTTCACAGCAGG | 723 | 740 | 5361 | 5378 | SEQ ID 2980 | CCTGCTGTGAAGACAGGG | 1.76 |
| SEQ ID 1353 | COMP ID 1353 | CACCCTGTCTTCACAGCA | 725 | 742 | 5363 | 5380 | SEQ ID 2981 | TGCTGTGAAGACAGGGTG | 1.15 |
| SEQ ID 1354 | COMP ID 1354 | TGCACCCTGTCTTCACAG | 727 | 744 | 5365 | 5382 | SEQ ID 2982 | CTGTGAAGACAGGGTGCA | 1.34 |
| SEQ ID 1355 | COMP ID 1355 | AGTGCACCCTGTCTTCAC | 729 | 746 | 5367 | 5384 | SEQ ID 2983 | GTGAAGACAGGGTGCACT | 2.19 |
| SEQ ID 1356 | COMP ID 1356 | GCAGTGCACCCTGTCTTC | 731 | 748 | 5369 | 5386 | SEQ ID 2984 | GAAGACAGGGTGCACTGC | 1.27 |
| SEQ ID 1357 | COMP ID 1357 | CAGCAGTGCACCCTGTCT | 733 | 750 | 5371 | 5388 | SEQ ID 2985 | AGACAGGGTGCACTGCTG | 1.66 |
| SEQ ID 1358 | COMP ID 1358 | GACAGCAGTGCACCCTGT | 735 | 752 | 5373 | 5390 | SEQ ID 2986 | ACAGGGTGCACTGCTGTC | no data |
| SEQ ID 1359 | COMP ID 1359 | CGGACAGCAGTGCACCCT | 737 | 754 | 5375 | 5392 | SEQ ID 2987 | AGGGTGCACTGCTGTCCG | no data |
| SEQ ID 1360 | COMP ID 1360 | TGCCGGACAGCAGTGCAC | 739 | 756 | 5377 | 5394 | SEQ ID 2988 | GGTGCACTGCTGTCCGCA | no data |
| SEQ ID 1361 | COMP ID 1361 | CGTGCCGGACAGCAGTGC | 741 | 758 | 5379 | 5396 | SEQ ID 2989 | TGCACTGCTGTCCGCACG | no data |
| SEQ ID 1362 | COMP ID 1362 | ACCGTGCCGGACAGCAGT | 743 | 760 | 5381 | 5398 | SEQ ID 2990 | CACTGCTGTCCGCACGGT | no data |
| SEQ ID 1363 | COMP ID 1363 | GCACCGTGCCGGACAGCA | 745 | 762 | 5383 | 5400 | SEQ ID 2991 | CTGCTGTCCGCACGGTGC | no data |
| SEQ ID 1364 | COMP ID 1364 | AGGCACCGTGCCGGACAGC | 747 | 764 | 5385 | 5402 | SEQ ID 2992 | GCTGTCCGCACGGTGCCT | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1365 | COMP ID 1365 | GAAGGCACCGTGCGGACA | 749 | 766 | 5387 | 5404 | SEQ ID 2993 | TGTCCGCACGGTGCCTTC | no data |
| SEQ ID 1366 | COMP ID 1366 | CAGAAGGCACCGTGCGGA | 751 | 768 | 5389 | 5406 | SEQ ID 2994 | TCCCGCACGGTGCCTTCTG | no data |
| SEQ ID 1367 | COMP ID 1367 | CGCAGAAGGCACCGTGCG | 753 | 770 | 5391 | 5408 | SEQ ID 2995 | CGCACGGTGCCTTCTGCG | no data |
| SEQ ID 1368 | COMP ID 1368 | GTCCAGAAGGCACCGTG | 755 | 772 | 5393 | 5410 | SEQ ID 2996 | CACGGTGCCTTCTGCGAC | no data |
| SEQ ID 1369 | COMP ID 1369 | AGTCGCAGAAGGCACCG | 757 | 774 | 5395 | 5412 | SEQ ID 2997 | CGGTGCCTTCTGCGACCT | no data |
| SEQ ID 1370 | COMP ID 1370 | CCAGGTCGCAGAAGGCAC | 759 | 776 | 5397 | 5414 | SEQ ID 2998 | GTGCCTTCTGCGACCTGG | no data |
| SEQ ID 1371 | COMP ID 1371 | AACCAGGTCGCAGAAGGC | 761 | 778 | 5399 | 5416 | SEQ ID 2999 | GCCTTCTGCGACCTGGTT | no data |
| SEQ ID 1372 | COMP ID 1372 | TGAACCAGGTCGCAGAAG | 763 | 780 | 5401 | 5418 | SEQ ID 3000 | CTTCTGCGACCTGGTTCA | no data |
| SEQ ID 1373 | COMP ID 1373 | TGTGAACCAGGTCGCAGA | 765 | 782 | 5403 | 5420 | SEQ ID 3001 | TCTGCGACCTGGTTCACA | no data |
| SEQ ID 1374 | COMP ID 1374 | GGTGTGAACCAGGTCGCA | 767 | 784 | 5405 | 5422 | SEQ ID 3002 | TGCGACCTGGTTCACACC | no data |
| SEQ ID 1375 | COMP ID 1375 | CGGGTGTGAACCAGGTCG | 769 | 786 | 5407 | 5424 | SEQ ID 3003 | CGACCTGGTTCACACCCG | no data |
| SEQ ID 1376 | COMP ID 1376 | AGCGGGTGTGAACCAGT | 771 | 788 | 5409 | 5426 | SEQ ID 3004 | ACCTGGTTCACACCCGCT | no data |
| SEQ ID 1377 | COMP ID 1377 | GCAGCGGGTGTGAACCAG | 773 | 790 | 5411 | 5428 | SEQ ID 3005 | CTGGTTCACACCCGCTGC | no data |
| SEQ ID 1378 | COMP ID 1378 | ATGCAGCGGGTGTGAACC | 775 | 792 | 5413 | 5430 | SEQ ID 3006 | GGTTCACACCCGCTGCAT | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1379 | COMP ID 1379 | TGATGCAGGGGTGTGAA | 777 | 794 | 5415 | 5432 | SEQ ID 3007 | TTCACACCCGCTGCATCA | no data |
| SEQ ID 1380 | COMP ID 1380 | TGTGATGCAGCGGGTGTG | 779 | 796 | 5417 | 5434 | SEQ ID 3008 | CACACCCGCTGCATCACA | no data |
| SEQ ID 1381 | COMP ID 1381 | GGTGTGATGCAGCGGGTG | 781 | 798 | 5419 | 5436 | SEQ ID 3009 | CACCCGCTGCATCACACC | no data |
| SEQ ID 1382 | COMP ID 1382 | TGGGTGTGATGCAGCGGG | 783 | 800 | 5421 | 5438 | SEQ ID 3010 | CCCGCTGCATCACACCCA | no data |
| SEQ ID 1383 | COMP ID 1383 | CGTGGGTGTGATGCAGCG | 785 | 802 | 5423 | 5440 | SEQ ID 3011 | CGCTGCATCACACCCACG | no data |
| SEQ ID 1384 | COMP ID 1384 | CCCGTGGGTGTGATGCAG | 787 | 804 | 5425 | 5442 | SEQ ID 3012 | CTGCATCACACCCACGGG | no data |
| SEQ ID 1385 | COMP ID 1385 | TGCCCGTGGGTGTGATGC | 789 | 806 | 5427 | 5444 | SEQ ID 3013 | GCATCACACCCACGGGCA | no data |
| SEQ ID 1386 | COMP ID 1386 | GGTGCCCGTGGGTGTGAT | 791 | 808 | 5429 | 5446 | SEQ ID 3014 | ATCACACCCACGGGCACC | no data |
| SEQ ID 1387 | COMP ID 1387 | TGGGTGCCCGTGGGTGTG | 793 | 810 | 5431 | 5448 | SEQ ID 3015 | CACACCCACGGGCACCCA | no data |
| SEQ ID 1388 | COMP ID 1388 | GGTGGGTGCCCGTGGGTG | 795 | 812 | 5433 | 5450 | SEQ ID 3016 | CACCCACGGGCACCCACC | no data |
| SEQ ID 1389 | COMP ID 1389 | GGGGTGGGTGCCCGTGGG | 797 | 814 | 5435 | 5452 | SEQ ID 3017 | CCCACGGGCACCCACCCC | no data |
| SEQ ID 1390 | COMP ID 1390 | AGGGGGTGGGTGCCCGTG | 799 | 816 | 5437 | 5454 | SEQ ID 3018 | CACGGGCACCCACCCCCT | no data |
| SEQ ID 1391 | COMP ID 1391 | CCAGGGGGTGGGTGCCCG | 801 | 818 | 5439 | 5456 | SEQ ID 3019 | CGGGCACCCACCCCCTGG | no data |
| SEQ ID 1392 | COMP ID 1392 | TGCCAGGGGGTGGGTGCC | 803 | 820 | 5441 | 5458 | SEQ ID 3020 | GGCACCCACCCCCTGGCA | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1393 | COMP ID 1393 | TTTGCCAGGGGTGGGTG | 805 | 822 | 5443 | 5460 | SEQ ID 3021 | CACCCACCCCTGGCAAA | no data |
| SEQ ID 1394 | COMP ID 1394 | TCTTTGCCAGGGGTGGG | 807 | 824 | 5445 | 5462 | SEQ ID 3022 | CCCACCCCTGGCAAAGA | no data |
| SEQ ID 1395 | COMP ID 1395 | CTTCTTTGCCAGGGGTG | 809 | 826 | 5447 | 5464 | SEQ ID 3023 | CACCCCCTGGCAAAGAAG | no data |
| SEQ ID 1396 | COMP ID 1396 | AGCTTCTTTGCCAGGGG | 811 | 828 | 5449 | 5466 | SEQ ID 3024 | CCCCTGGCAAAGAAGCT | no data |
| SEQ ID 1397 | COMP ID 1397 | GGAGCTTCTTTGCCAGG | 813 | 830 | 5451 | 5468 | SEQ ID 3025 | CCTGGCAAAGAAGAAGCTCC | no data |
| SEQ ID 1398 | COMP ID 1398 | AGGGAGCTTCTTTGCCAG | 815 | 832 | 5453 | 5470 | SEQ ID 3026 | CTGGCAAAGAAGCTCCT | no data |
| SEQ ID 1399 | COMP ID 1399 | GCAGGGAGCTTCTTTGCC | 817 | 834 | 5455 | 5472 | SEQ ID 3027 | GGCAAAGAAGCTCCCTGC | no data |
| SEQ ID 1400 | COMP ID 1400 | GGGCAGGGAGCTTCTTTG | 819 | 836 | 5457 | 5474 | SEQ ID 3028 | CAAAGAAGCTCCCTGCCC | no data |
| SEQ ID 1401 | COMP ID 1401 | CTGGGCAGGGAGCTTCTT | 821 | 838 | 5459 | 5476 | SEQ ID 3029 | AAGAAGCTCCCTGCCCAG | no data |
| SEQ ID 1402 | COMP ID 1402 | CTCTGGGCAGGGAGCTTC | 823 | 840 | 5461 | 5478 | SEQ ID 3030 | GAAGCTCCCTGCCCAGAG | no data |
| SEQ ID 1403 | COMP ID 1403 | TCCTCTGGGCAGGGAGCT | 825 | 842 | 5463 | 5480 | SEQ ID 3031 | AGCTCCCTGCCCAGAGGA | no data |
| SEQ ID 1404 | COMP ID 1404 | AGTCCTCTGGGCAGGGAG | 827 | 844 | 5465 | 5482 | SEQ ID 3032 | CTCCCTGCCCAGAGGACT | no data |
| SEQ ID 1405 | COMP ID 1405 | TTAGTCCTCTGGGCAGGG | 829 | 846 | 5467 | 5484 | SEQ ID 3033 | CCCTGCCCAGAGGACTAA | no data |
| SEQ ID 1406 | COMP ID 1406 | TGTTAGTCCTCTGGGCAG | 831 | 848 | 5469 | 5486 | SEQ ID 3034 | CTGCCCAGAGGACTAACA | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1407 | COMP ID 1407 | CCTGTTAGTCCTCTGGGC | 833 | 850 | 5471 | 5488 | SEQ ID 3035 | GCCCAGAGGACTAACAGG | no data |
| SEQ ID 1408 | COMP ID 1408 | GCCCTGTTAGTCCTCTGG | 835 | 852 | 5473 | 5490 | SEQ ID 3036 | CCAGAGGACTAACAGGGC | no data |
| SEQ ID 1409 | COMP ID 1409 | CTGCCCTGTTAGTCCTCT | 837 | 854 | 5475 | 5492 | SEQ ID 3037 | AGAGGACTAACAGGGCAG | no data |
| SEQ ID 1410 | COMP ID 1410 | ACCTGCCCTGTTAGTCCT | | | 5477 | 5494 | SEQ ID 3038 | AGGACTAACAGGGCAGGT | no data |
| SEQ ID 1411 | COMP ID 1411 | TCACCTGCCCTGTTAGTC | | | 5479 | 5496 | SEQ ID 3039 | GACTAACAGGGCAGGTGA | no data |
| SEQ ID 1412 | COMP ID 1412 | CCTCACCTGCCCTGTTAG | | | 5481 | 5498 | SEQ ID 3040 | CTAACAGGGCAGGTGAGG | no data |
| SEQ ID 1413 | COMP ID 1413 | CTCCTCACCTGCCCTGTT | | | 5483 | 5500 | SEQ ID 3041 | AACAGGGCAGGTGAGGAG | no data |
| SEQ ID 1414 | COMP ID 1414 | ACCTCCTCACCTGCCCTG | | | 5485 | 5502 | SEQ ID 3042 | CAGGGCAGGTGAGGAGGT | no data |
| SEQ ID 1415 | COMP ID 1415 | CCACCTCCTCACCTGCCC | | | 5487 | 5504 | SEQ ID 3043 | GGGCAGGTGAGGAGGTGG | no data |
| SEQ ID 1416 | COMP ID 1416 | TCCCACCTCCTCACCTGC | | | 5489 | 5506 | SEQ ID 3044 | GCAGGTGAGGAGGTGGGA | no data |
| SEQ ID 1417 | COMP ID 1417 | TCTCCCACCTCCTCACCT | | | 5491 | 5508 | SEQ ID 3045 | AGGTGAGGAGGTGGGAGA | no data |
| SEQ ID 1418 | COMP ID 1418 | GCTCTCCCACCTCCTCAC | | | 5493 | 5510 | SEQ ID 3046 | GTGAGGAGGTGGGAGAGC | no data |
| SEQ ID 1419 | COMP ID 1419 | ATGCTCTCCCACCTCCTC | | | 5495 | 5512 | SEQ ID 3047 | GAGGAGGTGGGAGAGCAT | no data |
| SEQ ID 1420 | COMP ID 1420 | TGATGCTCTCCCACCTCC | | | 5497 | 5514 | SEQ ID 3048 | GGAGGTGGGAGAGCATCA | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1421 | COMP ID 1421 | CCTGATGCTCTCCACCT | | | 5499 | 5516 | SEQ ID 3049 | AGGTGGGAGAGCATCAGG | no data |
| SEQ ID 1422 | COMP ID 1422 | GGCCTGATGCTCTCCAC | | | 5501 | 5518 | SEQ ID 3050 | GTGGGAGAGCATCAGGCC | no data |
| SEQ ID 1423 | COMP ID 1423 | CTGGCCTGATGCTCTCC | | | 5503 | 5520 | SEQ ID 3051 | GGGAGAGCATCAGGCCAG | no data |
| SEQ ID 1424 | COMP ID 1424 | CCCTGGCCTGATGCTCTC | | | 5505 | 5522 | SEQ ID 3052 | GAGAGCATCAGGCCAGGG | no data |
| SEQ ID 1425 | COMP ID 1425 | GCCCTGGCCTGATGCTC | | | 5507 | 5524 | SEQ ID 3053 | GAGCATCAGGCCAGGGGC | 1.58 |
| SEQ ID 1426 | COMP ID 1426 | CAGCCCTGGCCTGATGC | | | 5509 | 5526 | SEQ ID 3054 | GCATCAGGCCAGGGGCTG | 1.73 |
| SEQ ID 1427 | COMP ID 1427 | CCCAGCCCTGGCCTGAT | | | 5511 | 5528 | SEQ ID 3055 | ATCAGGCCAGGGGCTGGG | 1.59 |
| SEQ ID 1428 | COMP ID 1428 | GCCCCAGCCCTGGCCTG | | | 5513 | 5530 | SEQ ID 3056 | CAGGCCAGGGGCTGGGGC | 1.52 |
| SEQ ID 1429 | COMP ID 1429 | CCGCCCCAGCCCCTGGCC | | | 5515 | 5532 | SEQ ID 3057 | GGCCAGGGGCTGGGGCGG | 1.14 |
| SEQ ID 1430 | COMP ID 1430 | CCCCGCCCCAGCCCCTGG | | | 5517 | 5534 | SEQ ID 3058 | CCAGGGGCTGGGGGGGG | 1.58 |
| SEQ ID 1431 | COMP ID 1431 | GGCCCCGCCCCAGCCCT | | | 5519 | 5536 | SEQ ID 3059 | AGGGGCTGGGGGGGGCC | 1.56 |
| SEQ ID 1432 | COMP ID 1432 | GAGGCCCCGCCCCAGCC | | | 5521 | 5538 | SEQ ID 3060 | GGGCTGGGGGGGGCCTC | 1.7 |
| SEQ ID 1433 | COMP ID 1433 | ATGAGGCCCCGCCCCAGC | | | 5523 | 5540 | SEQ ID 3061 | GCTGGGGGGGGCCTCAT | 1.52 |
| SEQ ID 1434 | COMP ID 1434 | CAATGAGGCCCCGCCCCA | | | 5525 | 5542 | SEQ ID 3062 | TGGGGGGGGCCCTCATTG | 1.74 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1435 | COMP ID 1435 | ATGGAGGAAACTTTTCC | | | 5555 | 5572 | SEQ ID 3063 | GGAAAAGTTTCCTCCAT | 1.77 |
| SEQ ID 1436 | COMP ID 1436 | GGATGGAGGAAACTTTTT | | | 5557 | 5574 | SEQ ID 3064 | AAAAAGTTTCCTCCATCC | 2.6 |
| SEQ ID 1437 | COMP ID 1437 | CAGGATGGAGGAAACTTT | | | 5559 | 5576 | SEQ ID 3065 | AAAGTTTCCTCCATCCTG | 1.94 |
| SEQ ID 1438 | COMP ID 1438 | GCCAGGATGGAGGAAACT | | | 5561 | 5578 | SEQ ID 3066 | AGTTTCCTCCATCCTGGC | 1.72 |
| SEQ ID 1439 | COMP ID 1439 | CAGCCAGGATGGAGGAAA | | | 5563 | 5580 | SEQ ID 3067 | TTTCCTCCATCCTGGCTG | no data |
| SEQ ID 1440 | COMP ID 1440 | GGCAGCCAGGATGGAGGA | | | 5565 | 5582 | SEQ ID 3068 | TCCTCCATCCTGGCTGCC | 3.11 |
| SEQ ID 1441 | COMP ID 1441 | GGGGCAGCCAGGATGGAG | | | 5567 | 5584 | SEQ ID 3069 | CTCCATCCTGGCTGCCCC | 2.65 |
| SEQ ID 1442 | COMP ID 1442 | GAGGGGCAGCCAGGATGG | | | 5569 | 5586 | SEQ ID 3070 | CCATCCTGGCTGCCCCTC | 2.63 |
| SEQ ID 1443 | COMP ID 1443 | GTGAGGGGCAGCCAGGAT | | | 5571 | 5588 | SEQ ID 3071 | ATCCTGGCTGCCCCTCAC | 2.15 |
| SEQ ID 1444 | COMP ID 1444 | ACGTGAGGGGCAGCCAGG | | | 5573 | 5590 | SEQ ID 3072 | CCTGGCTGCCCCTCACGT | 2.66 |
| SEQ ID 1445 | COMP ID 1445 | AAACGTGAGGGGCAGCCA | | | 5575 | 5592 | SEQ ID 3073 | TGGCTGCCCCTCACGTTT | 2.59 |
| SEQ ID 1446 | COMP ID 1446 | GCAAACGTGAGGGGCAGC | | | 5577 | 5594 | SEQ ID 3074 | GCTGCCCCTCACGTTTGC | 3.29 |
| SEQ ID 1447 | COMP ID 1447 | GAGCAAACGTGAGGGGCA | | | 5579 | 5596 | SEQ ID 3075 | TGCCCCTCACGTTTGCTC | 2.45 |
| SEQ ID 1448 | COMP ID 1448 | AGGAGCAAACGTGAGGGG | | | 5581 | 5598 | SEQ ID 3076 | CCCCTCACGTTTGCTCCT | 2.77 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1449 | COMP ID 1449 | AGAGGAGCAAACGTGAGG | | | 5583 | 5600 | SEQ ID 3077 | CCTCACGTTTGCTCCTCT | 1.89 |
| SEQ ID 1450 | COMP ID 1450 | GAAGAGGAGCAAACGTGA | | | 5585 | 5602 | SEQ ID 3078 | TCACGTTTGCTCCTCTTC | 1.62 |
| SEQ ID 1451 | COMP ID 1451 | TGGAAGAGGAGCAAACGT | | | 5587 | 5604 | SEQ ID 3079 | ACGTTTGCTCCTCTTCCA | 2.33 |
| SEQ ID 1452 | COMP ID 1452 | CCGAGCTGGACAAGGCCA | 855 | 872 | 5606 | 5623 | SEQ ID 3080 | TGGCCTTGTCCAGCTCGG | 1.44 |
| SEQ ID 1453 | COMP ID 1453 | GACCGAGCTGGACAAGGC | 857 | 874 | 5608 | 5625 | SEQ ID 3081 | GCCTTGTCCAGCTCGGTC | 1.24 |
| SEQ ID 1454 | COMP ID 1454 | ATGACCGAGCTGGACAAG | 859 | 876 | 5610 | 5627 | SEQ ID 3082 | CTTGTCCAGCTCGGTCAT | 1.75 |
| SEQ ID 1455 | COMP ID 1455 | ACATGACCGAGCTGGACA | 861 | 878 | 5612 | 5629 | SEQ ID 3083 | TGTCCAGCTCGGTCATGT | 1.79 |
| SEQ ID 1456 | COMP ID 1456 | ACACATGACCGAGCTGGA | 863 | 880 | 5614 | 5631 | SEQ ID 3084 | TCCAGCTCGGTCATGTGT | 2.12 |
| SEQ ID 1457 | COMP ID 1457 | GGACACATGACCGAGCTG | 865 | 882 | 5616 | 5633 | SEQ ID 3085 | CAGCTCGGTCATGTGTCC | 1.52 |
| SEQ ID 1458 | COMP ID 1458 | CCGGACACATGACCGAGC | 867 | 884 | 5618 | 5635 | SEQ ID 3086 | GCTCGGTCATGTGTCCGG | 1.4 |
| SEQ ID 1459 | COMP ID 1459 | GTCCGGACACATGACCGA | 869 | 886 | 5620 | 5637 | SEQ ID 3087 | TCGGTCATGTGTCCGGAC | 1.42 |
| SEQ ID 1460 | COMP ID 1460 | GCGTCCGGACACATGACC | 871 | 888 | 5622 | 5639 | SEQ ID 3088 | GGTCATGTGTCCGGACGC | 1.94 |
| SEQ ID 1461 | COMP ID 1461 | GTGCGTCCGGACACATGA | 873 | 890 | 5624 | 5641 | SEQ ID 3089 | TCATGTGTCCGGACGCAC | 2.11 |
| SEQ ID 1462 | COMP ID 1462 | CCGTGCGTCCGGACACAT | 875 | 392 | 5626 | 5643 | SEQ ID 3090 | ATGTGTCCGGACGCACGG | 1.71 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1463 | COMP ID 1463 | GACCGTGCGTCCGACAC | 877 | 894 | 5628 | 5645 | SEQ ID 3091 | GTGTCCGGACGCACGGTC | 1.75 |
| SEQ ID 1464 | COMP ID 1464 | GGGACCGTGCGTCCGAC | 879 | 896 | 5630 | 5647 | SEQ ID 3092 | GTCCGGACGCACGGTCCC | 2.52 |
| SEQ ID 1465 | COMP ID 1465 | CCGGGACCGTGCGTCCGG | 881 | 898 | 5632 | 5649 | SEQ ID 3093 | CCGGACGCACGGTCCCGG | 1.4 |
| SEQ ID 1466 | COMP ID 1466 | CACCGGGACCGTGCGTCC | 883 | 900 | 5634 | 5651 | SEQ ID 3094 | GGACCACGGTCCCGGTG | 1.09 |
| SEQ ID 1467 | COMP ID 1467 | GGCACCGGGACCGTGCGT | 885 | 902 | 5636 | 5653 | SEQ ID 3095 | ACGCACGGTCCCGGTGCC | 2.16 |
| SEQ ID 1468 | COMP ID 1468 | AGGGCACCGGGACCGTGC | 887 | 904 | 5638 | 5655 | SEQ ID 3096 | GCACGGTCCCGGTGCCCT | no data |
| SEQ ID 1469 | COMP ID 1469 | TCAGGGCACCGGGACCGT | 889 | 906 | 5640 | 5657 | SEQ ID 3097 | ACGGTCCCGGTGCCCTGA | 1.69 |
| SEQ ID 1470 | COMP ID 1470 | CATCAGGGCACCGGGACC | 891 | 908 | 5642 | 5659 | SEQ ID 3098 | GGTCCCGGTGCCCTGATG | 1.31 |
| SEQ ID 1471 | COMP ID 1471 | ACCATCAGGGCACCGGGA | 893 | 910 | 5644 | 5661 | SEQ ID 3099 | TCCCGGTGCCCTGATGGT | 1.44 |
| SEQ ID 1472 | COMP ID 1472 | GAACCATCAGGGCACCGG | 895 | 912 | 5646 | 5663 | SEQ ID 3100 | CCGGTGCCCTGATGGTTC | 1.41 |
| SEQ ID 1473 | COMP ID 1473 | TAGAACCATCAGGGCACC | 897 | 914 | 5648 | 5665 | SEQ ID 3101 | GGTGCCCTGATGGTTCTA | no data |
| SEQ ID 1474 | COMP ID 1474 | GGTAGAACCATCAGGGCA | 899 | 916 | 5650 | 5667 | SEQ ID 3102 | TGCCCTGATGGTTCTACC | 1.57 |
| SEQ ID 1475 | COMP ID 1475 | CAGTAGAACCATCAGGG | 901 | 918 | 5652 | 5669 | SEQ ID 3103 | CCCTGATGGTTCTACCTG | 1.18 |
| SEQ ID 1476 | COMP ID 1476 | AGCAGGTAGAACCATCAG | 903 | 920 | 5654 | 5671 | SEQ ID 3104 | CTGATGGTTCTACCTGCT | 1.21 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every $2^{nd}$ or $3^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion End Position | Precursor-mRNA Position (SEQ ID NO 3949) Start Position | Precursor-mRNA Position End Position | Target Site Sequence ID | Target Site Sequence | Relative Progranulin expression (Relative to PBS) |
|---|---|---|---|---|---|---|---|---|---|
| SEQ ID 1477 | COMP ID 1477 | ACAGCAGGTAGAACCATC | 905 | 922 | 5656 | 5673 | SEQ ID 3105 | GATGTTCTACCTGCTGT | 1.05 |
| SEQ ID 1478 | COMP ID 1478 | TCACAGCAGGTAGAACCA | 907 | 924 | 5658 | 5675 | SEQ ID 3106 | TGGTTCTACCTGCTGTGA | 1.79 |
| SEQ ID 1479 | COMP ID 1479 | GCTCACAGCAGGTAGAAC | 909 | 926 | 5660 | 5677 | SEQ ID 3107 | GTTCTACCTGCTGTGAGC | 1.24 |
| SEQ ID 1480 | COMP ID 1480 | CAGCTCACAGCAGGTAGA | 911 | 928 | 5662 | 5679 | SEQ ID 3108 | TCTACCTGCTGTGAGCTG | 1.69 |
| SEQ ID 1481 | COMP ID 1481 | GGGCAGCTCACAGCAGGTA | 913 | 930 | 5664 | 5681 | SEQ ID 3109 | TACCTGCTGTGAGCTGCC | 1.29 |
| SEQ ID 1482 | COMP ID 1482 | TGGGCAGCTCACAGCAGG | 915 | 932 | 5666 | 5683 | SEQ ID 3110 | CCTGCTGTGAGCTGCCCA | 1.65 |
| SEQ ID 1483 | COMP ID 1483 | ACTGGGCAGCTCACAGCA | 917 | 934 | 5668 | 5685 | SEQ ID 3111 | TGCTGTGAGCTGCCCAGT | 0.89 |
| SEQ ID 1484 | COMP ID 1484 | CCACTGGGCAGCTCACAG | 919 | 936 | 5670 | 5687 | SEQ ID 3112 | CTGTGAGCTGCCCAGTGG | 1.26 |
| SEQ ID 1485 | COMP ID 1485 | TCCCACTGGGCAGCTCAC | 921 | 938 | 5672 | 5689 | SEQ ID 3113 | GTGAGCTGCCCAGTGGGA | 1.4 |
| SEQ ID 1486 | COMP ID 1486 | CTTCCCACTGGGCAGCTC | 923 | 940 | 5674 | 5691 | SEQ ID 3114 | GAGCTGCCCAGTGGGAAG | no data |
| SEQ ID 1487 | COMP ID 1487 | TACTTCCCACTGGGCAGC | 925 | 942 | 5676 | 5693 | SEQ ID 3115 | GCTCCCAGTGGGAAGTA | 1.37 |
| SEQ ID 1488 | COMP ID 1488 | CATACTTCCCACTGGGCA | 927 | 944 | 5678 | 5695 | SEQ ID 3116 | TGCCCAGTGGGAAGTATG | 1.5 |
| SEQ ID 1489 | COMP ID 1489 | GCCATACTTCCCACTGGG | 929 | 946 | 5680 | 5697 | SEQ ID 3117 | CCCAGTGGGAAGTATGGC | 1.08 |
| SEQ ID 1490 | COMP ID 1490 | CAGCCATACTTCCCACTG | 931 | 948 | 5682 | 5699 | SEQ ID 3118 | CAGTGGGAAGTATGGCTG | 0.8 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1491 | COMP ID 1491 | AGCAGCCATACTTCCCAC | 933 | 950 | 5684 | 5701 | SEQ ID 3119 | GTGGGAAGTATGGCTGCT | 1.06 |
| SEQ ID 1492 | COMP ID 1492 | GCAGCAGCCATACTTCCC | 935 | 952 | 5686 | 5703 | SEQ ID 3120 | GGGAAGTATGGCTGCTGC | 1.59 |
| SEQ ID 1493 | COMP ID 1493 | GGGCAGCAGCCATACTTC | 937 | 954 | 5688 | 5705 | SEQ ID 3121 | GAAGTATGGCTGCTGCCC | 1.95 |
| SEQ ID 1494 | COMP ID 1494 | TTGGGCAGCAGCCATACT | 939 | 956 | 5690 | 5707 | SEQ ID 3122 | AGTATGGCTGCTGCCCAA | 1.36 |
| SEQ ID 1495 | COMP ID 1495 | CATTGGGCAGCAGCCATA | 941 | 958 | 5692 | 5709 | SEQ ID 3123 | TATGGCTGCTGCCCAATG | 1.36 |
| SEQ ID 1496 | COMP ID 1496 | GGCATTGGGCAGCAGCCA | 943 | 960 | 5694 | 5711 | SEQ ID 3124 | TGGCTGCTGCCCAATGCC | 1.49 |
| SEQ ID 1497 | COMP ID 1497 | TGGGCATTGGGCAGCAGC | 945 | 962 | 5696 | 5713 | SEQ ID 3125 | GCTGCTGCCCAATGCCCA | 1.56 |
| SEQ ID 1498 | COMP ID 1498 | GTTGGGCATTGGGCAGCA | 947 | 964 | 5698 | 5715 | SEQ ID 3126 | TGCTGCCCAATGCCCAAC | 1.56 |
| SEQ ID 1499 | COMP ID 1499 | GCTCCAGCCCCTCACTCA | | | 5717 | 5734 | SEQ ID 3127 | TGAGTGAGGGGCTGGAGC | 1.37 |
| SEQ ID 1500 | COMP ID 1500 | TGGCTCCAGCCCCTCACT | | | 5719 | 5736 | SEQ ID 3128 | AGTGAGGGGCTGGAGCCA | 1.21 |
| SEQ ID 1501 | COMP ID 1501 | GCTGGCTCCAGCCCCTCA | | | 5721 | 5738 | SEQ ID 3129 | TGAGGGGCTGGAGCCAGC | 1.23 |
| SEQ ID 1502 | COMP ID 1502 | AAGCTGGCTCCAGCCCCT | | | 5723 | 5740 | SEQ ID 3130 | AGGGGCTGGAGCCAGCTT | 1.16 |
| SEQ ID 1503 | COMP ID 1503 | CCAAGCTGGCTCCAGCCC | | | 5725 | 5742 | SEQ ID 3131 | GGGCTGGAGCCAGCTTGG | 1.06 |
| SEQ ID 1504 | COMP ID 1504 | AGCCAAGCTGGCTCCAGC | | | 5727 | 5744 | SEQ ID 3132 | GCTGGAGCCAGCTTGGCT | 1.25 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1505 | COMP ID 1505 | ACAGCCAAGTGCTCCA | | | 5729 | 5746 | SEQ ID 3133 | TGGAGCCAGCTTGGCTGT | 1.75 |
| SEQ ID 1506 | COMP ID 1506 | ACACAGCCAAGTGGCTC | | | 5731 | 5748 | SEQ ID 3134 | GAGCCAGCTTGGCTGTGT | 1.96 |
| SEQ ID 1507 | COMP ID 1507 | GCACACAGCCAAGTGGC | | | 5733 | 5750 | SEQ ID 3135 | GCCAGCTTGGCTGTGTGC | 1.7 |
| SEQ ID 1508 | COMP ID 1508 | GGGCACACAGCCAAGTG | | | 5735 | 5752 | SEQ ID 3136 | CAGCTTGGCTGTGTGCCC | 1.38 |
| SEQ ID 1509 | COMP ID 1509 | GGGGGCACACAGCCAAGC | | | 5737 | 5754 | SEQ ID 3137 | GCTTGGCTGTGTGCCCCC | 2.09 |
| SEQ ID 1510 | COMP ID 1510 | CTGGGGGCACACAGCCAA | | | 5739 | 5756 | SEQ ID 3138 | TTGGCTGTGTGCCCCCAG | 2.15 |
| SEQ ID 1511 | COMP ID 1511 | GGCTGGGGGCACACAGCC | | | 5741 | 5758 | SEQ ID 3139 | GGCTGTGTGCCCCCAGCC | 1.46 |
| SEQ ID 1512 | COMP ID 1512 | GTGCTGGGGGCACACAG | | | 5743 | 5760 | SEQ ID 3140 | CTGTGTGCCCCCAGCCAC | 1.67 |
| SEQ ID 1513 | COMP ID 1513 | AGGTGGCTGGGGGCACAC | | | 5745 | 5762 | SEQ ID 3141 | GTGTGCCCCCAGCCACCT | 2.14 |
| SEQ ID 1514 | COMP ID 1514 | CCAGGTGCTGGGGGCAC | | | 5747 | 5764 | SEQ ID 3142 | GTGCCCCCAGCCACCTGG | 1.51 |
| SEQ ID 1515 | COMP ID 1515 | GGCCAGGTGGCTGGGGGC | | | 5749 | 5766 | SEQ ID 3143 | GCCCCCAGCCACCTGGCC | 2.43 |
| SEQ ID 1516 | COMP ID 1516 | CCAGCCCCATGCCACAGA | | | 5789 | 5806 | SEQ ID 3144 | TCTGTGGCATGGGGCTGG | 1.27 |
| SEQ ID 1517 | COMP ID 1517 | AGCCAGCCCCATGCCACA | | | 5791 | 5808 | SEQ ID 3145 | TGTGGCATGGGGCTGGCT | 1.56 |
| SEQ ID 1518 | COMP ID 1518 | CCAGCCAGCCCCATGCCA | | | 5793 | 5810 | SEQ ID 3146 | TGGCATGGGGCTGCTGG | 1.14 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1519 | COMP ID 1519 | CCTGCATCAGCCAGGCTC | | | 5822 | 5839 | SEQ ID 3147 | GAGCCTGGCTGATGCAGG | 1.44 |
| SEQ ID 1520 | COMP ID 1520 | ACCCTGCATCAGCCAGGC | | | 5824 | 5841 | SEQ ID 3148 | GCCTGGCTGATGCAGGGT | 1.56 |
| SEQ ID 1521 | COMP ID 1521 | GAACCCTGCATCAGCCAG | | | 5826 | 5843 | SEQ ID 3149 | CTGGCTGATGCAGGGTTC | 1.22 |
| SEQ ID 1522 | COMP ID 1522 | ATGAACCCTGCATCAGCC | | | 5828 | 5845 | SEQ ID 3150 | GGCTGATGCAGGGTTCAT | 1.37 |
| SEQ ID 1523 | COMP ID 1523 | TCCAGGCTCAGTAGCACA | | | 5902 | 5919 | SEQ ID 3151 | TGTGCTACTGAGCCTGGA | 1.43 |
| SEQ ID 1524 | COMP ID 1524 | CTTCCAGGCTCAGTAGCA | | | 5904 | 5921 | SEQ ID 3152 | TGCTACTGAGCCTGGAAG | 1.76 |
| SEQ ID 1525 | COMP ID 1525 | CACTTCCAGGCTCAGTAG | | | 5906 | 5923 | SEQ ID 3153 | CTACTGAGCCTGGAAGTG | 1.52 |
| SEQ ID 1526 | COMP ID 1526 | GTCACTTCCAGGCTCAGT | | | 5908 | 5925 | SEQ ID 3154 | ACTGAGCCTGGAAGTGAC | 1.48 |
| SEQ ID 1527 | COMP ID 1527 | TTGTCACTTCCAGGCTCA | | | 5910 | 5927 | SEQ ID 3155 | TGAGCCTGGAAGTGACAA | 1.47 |
| SEQ ID 1528 | COMP ID 1528 | CTTTGTCACTTCCAGGCT | | | 5912 | 5929 | SEQ ID 3156 | AGCCTGGAAGTGACAAAG | 1.78 |
| SEQ ID 1529 | COMP ID 1529 | GTCTTTGTCACTTCCAGG | | | 5914 | 5931 | SEQ ID 3157 | CCTGGAAGTGACAAAGAC | 1.55 |
| SEQ ID 1530 | COMP ID 1530 | GGGTCTTTGTCACTTCCA | | | 5916 | 5933 | SEQ ID 3158 | TGGAAGTGACAAAGACCC | 2.02 |
| SEQ ID 1531 | COMP ID 1531 | GTGGGTCTTTGTCACTTC | | | 5918 | 5935 | SEQ ID 3159 | GAAGTGACAAAGACCCAC | 1.94 |
| SEQ ID 1532 | COMP ID 1532 | GGGTGGGTCTTTGTCACT | | | 5920 | 5937 | SEQ ID 3160 | AGTGACAAAGACCCACCC | 1.91 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1533 | COMP ID 1533 | AGGGGTGGGTCTTTGTCA | | | 5922 | 5939 | SEQ ID 3161 | TGACAAAGACCCACCCCT | 2.21 |
| SEQ ID 1534 | COMP ID 1534 | ACAGGGGTGGGTCTTTGT | | | 5924 | 5941 | SEQ ID 3162 | ACAAAGACCCACCCCTGT | 2.12 |
| SEQ ID 1535 | COMP ID 1535 | GGACAGGGGTGGGTCTTT | | | 5926 | 5943 | SEQ ID 3163 | AAAGACCCACCCCTGTCC | 2.22 |
| SEQ ID 1536 | COMP ID 1536 | GGGGACAGGGGTGGGTCT | | | 5928 | 5945 | SEQ ID 3164 | AGACCCACCCCTGTCCC | 2.37 |
| SEQ ID 1537 | COMP ID 1537 | GTGGGGACAGGGGTGGGT | | | 5930 | 5947 | SEQ ID 3165 | ACCCACCCCTGTCCCCAC | 2.32 |
| SEQ ID 1538 | COMP ID 1538 | GAGTGGGGACAGGGGTGG | | | 5932 | 5949 | SEQ ID 3166 | CCACCCCTGTCCCCACTC | 2.82 |
| SEQ ID 1539 | COMP ID 1539 | CTGAGTGGGGACAGGGGT | | | 5934 | 5951 | SEQ ID 3167 | ACCCCTGTCCCCACTCAG | 2.26 |
| SEQ ID 1540 | COMP ID 1540 | GATCGGAGCAGCAGGTGG | 966 | 983 | 5953 | 5970 | SEQ ID 3168 | CCACTGCTGCTCCGATC | 2.03 |
| SEQ ID 1541 | COMP ID 1541 | GTGATCGGAGCAGCAGGT | 968 | 985 | 5955 | 5972 | SEQ ID 3169 | ACCTGCTGCTCCGATCAC | 1.66 |
| SEQ ID 1542 | COMP ID 1542 | AGGTGATCGGAGCAGCAG | 970 | 987 | 5957 | 5974 | SEQ ID 3170 | CTGCTGCTCCGATCACCT | 2 |
| SEQ ID 1543 | COMP ID 1543 | GCAGGTGATCGGAGCAGC | 972 | 989 | 5959 | 5976 | SEQ ID 3171 | GCTGCTCCGATCACCTGC | 1.32 |
| SEQ ID 1544 | COMP ID 1544 | GTGCAGGTGATCGGAGCA | 974 | 991 | 5961 | 5978 | SEQ ID 3172 | TGCTCCGATCACCTGCAC | 1.62 |
| SEQ ID 1545 | COMP ID 1545 | CAGTGCAGGTGATCGGAG | 976 | 993 | 5963 | 5980 | SEQ ID 3173 | CTCCGATCACCTGCACTG | 2.12 |
| SEQ ID 1546 | COMP ID 1546 | AGCAGTGCAGGTGATCGG | 978 | 995 | 5965 | 5982 | SEQ ID 3174 | CCGATCACCTGCACTGCT | 1.58 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1547 | COMP ID 1547 | GCAGCAGTGCAGGTGATC | 980 | 997 | 5967 | 5984 | SEQ ID 3175 | GATCACCTGCACTGCTGC | 1.83 |
| SEQ ID 1548 | COMP ID 1548 | GGGCAGCAGTGCAGGTGA | 982 | 999 | 5969 | 5986 | SEQ ID 3176 | TCACCTGCACTGCTGCCC | 2.37 |
| SEQ ID 1549 | COMP ID 1549 | GGGGGCAGCAGTGCAGGT | 984 | 1001 | 5971 | 5988 | SEQ ID 3177 | ACCTGCACTGCTGCCCCC | 2.03 |
| SEQ ID 1550 | COMP ID 1550 | TTGGGGCAGCAGTGCAG | 986 | 1003 | 5973 | 5990 | SEQ ID 3178 | CTGCACTGCTGCCCCCAA | 1.99 |
| SEQ ID 1551 | COMP ID 1551 | TCTTGGGGCAGCAGTGC | 988 | 1005 | 5975 | 5992 | SEQ ID 3179 | GCACTGCTGCCCCCAAGA | 1.77 |
| SEQ ID 1552 | COMP ID 1552 | TGTCTTGGGGCAGCAGT | 990 | 1007 | 5977 | 5994 | SEQ ID 3180 | ACTGCTGCCCCCAAGACA | 1.68 |
| SEQ ID 1553 | COMP ID 1553 | AGTGTCTTGGGGCAGCA | 992 | 1009 | 5979 | 5996 | SEQ ID 3181 | TGCTGCCCCCAAGACACT | 2.12 |
| SEQ ID 1554 | COMP ID 1554 | ACAGTGTCTTGGGGCAG | 994 | 1011 | 5981 | 5998 | SEQ ID 3182 | CTGCCCCCAAGACACTGT | 1.93 |
| SEQ ID 1555 | COMP ID 1555 | ACACAGTGTCTTGGGGC | 996 | 1013 | 5983 | 6000 | SEQ ID 3183 | GCCCCCAAGACACTGTGT | 2.21 |
| SEQ ID 1556 | COMP ID 1556 | ACACAGTGTCTTGGG | 998 | 1015 | 5985 | 6002 | SEQ ID 3184 | CCCCAAGACACTGTGTGT | 1.79 |
| SEQ ID 1557 | COMP ID 1557 | TCACACAGTGTCTTGG | 1000 | 1017 | 5987 | 6004 | SEQ ID 3185 | CCAAGACACTGTGTGTGA | 1.39 |
| SEQ ID 1558 | COMP ID 1558 | GGTCACACAGTGTCTT | 1002 | 1019 | 5989 | 6006 | SEQ ID 3186 | AAGACACTGTGTGACC | 1.72 |
| SEQ ID 1559 | COMP ID 1559 | CAGGTCACACAGTGTC | 1004 | 1021 | 5991 | 6008 | SEQ ID 3187 | GACACTGTGTGACCTG | 1.43 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1560 | COMP ID 1560 | ATCAGGTCACACACAGTG | 1006 | 1023 | 5993 | 6010 | SEQ ID 3188 | CACTGTGTGTGACCTGAT | 1.63 |
| SEQ ID 1561 | COMP ID 1561 | GGATCAGGTCACACACAG | 1008 | 1025 | 5995 | 6012 | SEQ ID 3189 | CTGTGTGTGACCTGATCC | 1.44 |
| SEQ ID 1562 | COMP ID 1562 | CTGGATCAGGTCACACAC | 1010 | 1027 | 5997 | 6014 | SEQ ID 3190 | GTGTGTGACCTGATCCAG | 1.15 |
| SEQ ID 1563 | COMP ID 1563 | CTCTGGATCAGGTCACAC | 1012 | 1029 | 5999 | 6016 | SEQ ID 3191 | GTGTGACCTGATCCAGAG | 1.56 |
| SEQ ID 1564 | COMP ID 1564 | TACTCTGGATCAGGTCAC | 1014 | 1031 | 6001 | 6018 | SEQ ID 3192 | GTGACCTGATCCAGAGTA | 1.45 |
| SEQ ID 1565 | COMP ID 1565 | CTTACTCTGGATCAGGTC | 1016 | 1033 | 6003 | 6020 | SEQ ID 3193 | GACCTGATCCAGAGTAAG | 1.51 |
| SEQ ID 1566 | COMP ID 1566 | CACTTACTCTGGATCAGG | 1018 | 1035 | 6005 | 6022 | SEQ ID 3194 | CCTGATCCAGAGTAAGTG | 1.39 |
| SEQ ID 1567 | COMP ID 1567 | GGCACTTACTCTGGATCA | 1020 | 1037 | 6007 | 6024 | SEQ ID 3195 | TGATCCAGAGTAAGTGCC | 1.28 |
| SEQ ID 1568 | COMP ID 1568 | GAGGCACTTACTCTGGAT | 1022 | 1039 | 6009 | 6026 | SEQ ID 3196 | ATCCAGAGTAAGTGCCTC | 1.53 |
| SEQ ID 1569 | COMP ID 1569 | GAGAGGCACTTACTCTGG | 1024 | 1041 | 6011 | 6028 | SEQ ID 3197 | CCAGAGTAAGTGCCTCTC | 1.5 |
| SEQ ID 1570 | COMP ID 1570 | TGGAGAGGCACTTACTCT | 1026 | 1043 | 6013 | 6030 | SEQ ID 3198 | AGAGTAAGTGCCTCTCCA | 1.39 |
| SEQ ID 1571 | COMP ID 1571 | CTTGGAGAGGCACTTACT | 1028 | 1045 | 6015 | 6032 | SEQ ID 3199 | AGTAAGTGCCTCTCCAAG | 1.37 |
| SEQ ID 1572 | COMP ID 1572 | TCCTTGGAGAGGCACTTA | 1030 | 1047 | 6017 | 6034 | SEQ ID 3200 | TAAGTGCCTCTCCAAGGA | 1.3 |
| SEQ ID 1573 | COMP ID 1573 | TCTCCTTGGAGAGGCACT | 1032 | 1049 | 6019 | 6036 | SEQ ID 3201 | AGTGCCTCTCCAAGGAGA | 1.26 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1574 | COMP ID 1574 | GTTCTCCTTGGAGAGGCA | 1034 | 1051 | 6021 | 6038 | SEQ ID 3202 | TGCCTCTCCAAGGAGAAC | 1.17 |
| SEQ ID 1575 | COMP ID 1575 | GCGTTCTCCTTGGAGAGG | 1036 | 1053 | 6023 | 6040 | SEQ ID 3203 | CCTCTCCAAGGAGAACGC | 1.65 |
| SEQ ID 1576 | COMP ID 1576 | TAGCGTTCTCCTTGGAGA | 1038 | 1055 | 6025 | 6042 | SEQ ID 3204 | TCTCCAAGGAGAACGCTA | 1.36 |
| SEQ ID 1577 | COMP ID 1577 | GGTAGCGTTCTCCTTGGA | 1040 | 1057 | 6027 | 6044 | SEQ ID 3205 | TCCAAGGAGAACGCTACC | 1.86 |
| SEQ ID 1578 | COMP ID 1578 | GTGGTAGCGTTCTCCTTG | 1042 | 1059 | 6029 | 6046 | SEQ ID 3206 | CAAGGAGAACGCTACCAC | 1.81 |
| SEQ ID 1579 | COMP ID 1579 | CCGTGGTAGCGTTCTCCT | 1044 | 1061 | 6031 | 6048 | SEQ ID 3207 | AGGAGAACGCTACCACGG | 1.52 |
| SEQ ID 1580 | COMP ID 1580 | GTCCGTGGTAGCGTTCTC | 1046 | 1063 | 6033 | 6050 | SEQ ID 3208 | GAGAACGCTACCACGGAC | 1.3 |
| SEQ ID 1581 | COMP ID 1581 | AGGTCCGTGGTAGCGTTC | 1048 | 1065 | 6035 | 6052 | SEQ ID 3209 | GAACGCTACCACGGACCT | 1.25 |
| SEQ ID 1582 | COMP ID 1582 | GGAGGTCCGTGGTAGCGT | 1050 | 1067 | 6037 | 6054 | SEQ ID 3210 | ACGCTACCACGGACCTCC | 2.11 |
| SEQ ID 1583 | COMP ID 1583 | GAGGAGGTCCGTGGTAGC | 1052 | 1069 | 6039 | 6056 | SEQ ID 3211 | GCTACCACGGACCTCCTC | 2.26 |
| SEQ ID 1584 | COMP ID 1584 | GTGAGGAGGTCCGTGGTA | 1054 | 1071 | 6041 | 6058 | SEQ ID 3212 | TACCACGGACCTCCTCAC | 1.9 |
| SEQ ID 1585 | COMP ID 1585 | TAGTGAGGAGGTCCGTGG | 1056 | 1073 | 6043 | 6060 | SEQ ID 3213 | CCACGGACCTCCTCACTA | 1.88 |
| SEQ ID 1586 | COMP ID 1586 | CTTAGTGAGGAGGTCCGT | 1058 | 1075 | 6045 | 6062 | SEQ ID 3214 | ACGGACCTCCTCACTAAG | 1.88 |
| SEQ ID 1587 | COMP ID 1587 | AGCTTAGTGAGGAGGTCC | 1060 | 1077 | 6047 | 6064 | SEQ ID 3215 | GGACCTCCTCACTAAGCT | 1.83 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1588 | COMP ID 1588 | GCAGCTTAGTGAGGAGGT | 1062 | 1079 | 6049 | 6066 | SEQ ID 3216 | ACCTCCTCACTAAGCTGC | 2.35 |
| SEQ ID 1589 | COMP ID 1589 | AGGCAGCTTAGTGAGGAG | 1064 | 1081 | 6051 | 6068 | SEQ ID 3217 | CTCCTCACTAAGCTGCCT | 1.97 |
| SEQ ID 1590 | COMP ID 1590 | GCAGGCAGCTTAGTGAGG | 1066 | 1083 | 6053 | 6070 | SEQ ID 3218 | CCTCACTAAGCTGCCTGC | 2.13 |
| SEQ ID 1591 | COMP ID 1591 | GCCGCAGGCAGCTTAGTGA | 1068 | 1085 | 6055 | 6072 | SEQ ID 3219 | TCACTAAGCTGCCTGCGC | 2.16 |
| SEQ ID 1592 | COMP ID 1592 | GTGCGCAGGCAGCTTAGT | 1070 | 1087 | 6057 | 6074 | SEQ ID 3220 | ACTAAGCTGCCTGCGCAC | 1.48 |
| SEQ ID 1593 | COMP ID 1593 | GTGTGCGCAGGCAGCTTA | 1072 | 1089 | 6059 | 6076 | SEQ ID 3221 | TAAGCTGCCTGCGCACAC | 1.67 |
| SEQ ID 1594 | COMP ID 1594 | CTGTGTGCGCAGGCAGCT | 1074 | 1091 | 6061 | 6078 | SEQ ID 3222 | AGCTGCCTGCGCACACAG | 1.67 |
| SEQ ID 1595 | COMP ID 1595 | TGCACCCTGCCTCTGGTA | | | 6080 | 6097 | SEQ ID 3223 | TACCAGAGGCAGGGTGCA | 1.72 |
| SEQ ID 1596 | COMP ID 1596 | TCTGCACCCTGCCTCTGG | | | 6082 | 6099 | SEQ ID 3224 | CCAGAGGCAGGGTGCAGA | 1.74 |
| SEQ ID 1597 | COMP ID 1597 | TATCTGCACCCTGCCTCT | | | 6084 | 6101 | SEQ ID 3225 | AGAGGCAGGGTGCAGATA | 1.38 |
| SEQ ID 1598 | COMP ID 1598 | TGTATCTGCACCCTGCCT | | | 6086 | 6103 | SEQ ID 3226 | AGGCAGGGTGCAGATACA | 1.36 |
| SEQ ID 1599 | COMP ID 1599 | CCTGTATCTGCACCCTGC | | | 6088 | 6105 | SEQ ID 3227 | GCAGGGTGCAGATACAGG | 1.62 |
| SEQ ID 1600 | COMP ID 1600 | CCCCTGTATCTGCACCCT | | | 6090 | 6107 | SEQ ID 3228 | AGGGTGCAGATACAGGGG | 1.31 |
| SEQ ID 1601 | COMP ID 1601 | CACCCCTGTATCTGCACC | | | 6092 | 6109 | SEQ ID 3229 | GGTGCAGATACAGGGGTG | 1.13 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) Position End | Target Site Sequence ID | Target Site Sequence | Relative Progranulin expression (Relative to PBS) |
|---|---|---|---|---|---|---|---|---|---|
| SEQ ID 1602 | COMP ID 1602 | CCCACCCTGTATCTGCA | | | 6094 | 6111 | SEQ ID 3230 | TGCAGATACAGGGTGGG | 1.11 |
| SEQ ID 1603 | COMP ID 1603 | GCCCCACCCTGTATCTG | | | 6096 | 6113 | SEQ ID 3231 | CAGATACAGGGGTGGGGC | 1.38 |
| SEQ ID 1604 | COMP ID 1604 | GGGCCCCACCCCTGTATC | | | 6098 | 6115 | SEQ ID 3232 | GATACAGGGGTGGGGCCC | 1.42 |
| SEQ ID 1605 | COMP ID 1605 | GGGGGCCCCACCCCTGTA | | | 6100 | 6117 | SEQ ID 3233 | TACAGGGGTGGGGCCCCC | 1.14 |
| SEQ ID 1606 | COMP ID 1606 | AAGGGGGCCCCACCCCTG | | | 6102 | 6119 | SEQ ID 3234 | CAGGGGTGGGGCCCCCTT | 1.16 |
| SEQ ID 1607 | COMP ID 1607 | GAAAGGGGGCCCCACCCC | | | 6104 | 6121 | SEQ ID 3235 | GGGGTGGGGCCCCCTTTC | 1.34 |
| SEQ ID 1608 | COMP ID 1608 | AGGAAAGGGGGCCCCACC | | | 6106 | 6123 | SEQ ID 3236 | GGTGGGGCCCCCTTTCCT | 1.74 |
| SEQ ID 1609 | COMP ID 1609 | GGAGGAAAGGGGGCCCCA | | | 6108 | 6125 | SEQ ID 3237 | TGGGGCCCCCTTTCCTCC | 2.14 |
| SEQ ID 1610 | COMP ID 1610 | AGGGAGGAAAGGGGGCCC | | | 6110 | 6127 | SEQ ID 3238 | GGGCCCCCTTTCCTCCCT | 2.26 |
| SEQ ID 1611 | COMP ID 1611 | AAAGGGAGGAAAGGGGGC | | | 6112 | 6129 | SEQ ID 3239 | GCCCCCTTTCCTCCCTTT | 2.14 |
| SEQ ID 1612 | COMP ID 1612 | TAAAAGGGAGGAAAGGGG | | | 6114 | 6131 | SEQ ID 3240 | CCCCTTTCCTCCCTTTTA | 2.13 |
| SEQ ID 1613 | COMP ID 1613 | CCTAAAAGGGAGGAAAGG | | | 6116 | 6133 | SEQ ID 3241 | CCTTTCCTCCCTTTTAGG | 1.65 |
| SEQ ID 1614 | COMP ID 1614 | GGCCTAAAAGGGAGGAAA | | | 6118 | 6135 | SEQ ID 3242 | TTTCCTCCCTTTTAGGCC | 2.24 |
| SEQ ID 1615 | COMP ID 1615 | CAGGCCTAAAAGGGAGGA | | | 6120 | 6137 | SEQ ID 3243 | TCCTCCCTTTTAGGCCTG | 1.97 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1616 | COMP ID 1616 | GCCAGGCCTAAAAGGGAG | | | 6122 | 6139 | SEQ ID 3244 | CTCCCTTTAGGCCTGGC | 1.76 |
| SEQ ID 1617 | COMP ID 1617 | AGGCCAGGCCTAAAAGGG | | | 6124 | 6141 | SEQ ID 3245 | CCCTTTAGGCCTGGCCT | 1.76 |
| SEQ ID 1618 | COMP ID 1618 | TAAGGCCAGGCCTAAAAG | | | 6126 | 6143 | SEQ ID 3246 | CTTTTAGGCCTGGCCTTA | 1.9 |
| SEQ ID 1619 | COMP ID 1619 | CCTAAGGCCAGGCCTAAA | | | 6128 | 6145 | SEQ ID 3247 | TTTAGGCCTGGCCTTAGG | 0.98 |
| SEQ ID 1620 | COMP ID 1620 | ATCCTAAGGCCAGGCCTA | | | 6130 | 6147 | SEQ ID 3248 | TAGGCCTGGCCTTAGGAT | 1.56 |
| SEQ ID 1621 | COMP ID 1621 | TGATCCTAAGGCCAGGCC | | | 6132 | 6149 | SEQ ID 3249 | GGCCTGGCCTTAGGATCA | 1.63 |
| SEQ ID 1622 | COMP ID 1622 | AGTGATCCTAAGGCCAGG | | | 6134 | 6151 | SEQ ID 3250 | CCTGGCCTTAGGATCACT | 2.63 |
| SEQ ID 1623 | COMP ID 1623 | GCAGTGATCCTAAGGCCA | | | 6136 | 6153 | SEQ ID 3251 | TGGCCTTAGGATCACTGC | 2.04 |
| SEQ ID 1624 | COMP ID 1624 | TTGCAGTGATCCTAAGGC | | | 6138 | 6155 | SEQ ID 3252 | GCCTTAGGATCACTGCAA | 1.74 |
| SEQ ID 1625 | COMP ID 1625 | CCTTGCAGTGATCCTAAG | | | 6140 | 6157 | SEQ ID 3253 | CTTAGGATCACTGCAAGG | 1.33 |
| SEQ ID 1626 | COMP ID 1626 | CACCTTGCAGTGATCCTA | | | 6142 | 6159 | SEQ ID 3254 | TAGGATCACTGCAAGGTG | 1.55 |
| SEQ ID 1627 | COMP ID 1627 | ACCACCTTGCAGTGATCC | | | 6144 | 6161 | SEQ ID 3255 | GGATCACTGCAAGGTGGT | 1.42 |
| SEQ ID 1628 | COMP ID 1628 | ACACCACCTTGCAGTGAT | | | 6146 | 6163 | SEQ ID 3256 | ATCACTGCAAGGTGGTGT | 1.38 |
| SEQ ID 1629 | COMP ID 1629 | GGCACTGGGGACCCTCAG | | | 6227 | 6244 | SEQ ID 3257 | CTGAGGGTCCCCAGTGCC | 1.18 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1630 | COMP ID 1630 | GTGCCACTGGGACCCTC | | | 6229 | 6246 | SEQ ID 3258 | GAGGTCCCCAGTGCCAC | 1.87 |
| SEQ ID 1631 | COMP ID 1631 | AAGTGGCACTGGGACCC | | | 6231 | 6248 | SEQ ID 3259 | GGGTCCCCAGTGCCACTT | 1.76 |
| SEQ ID 1632 | COMP ID 1632 | AGAAGTGGCACTGGGAC | | | 6233 | 6250 | SEQ ID 3260 | GTCCCCAGTGCCACTTCT | 1.3 |
| SEQ ID 1633 | COMP ID 1633 | TCAGAAGTGGCACTGGGG | | | 6235 | 6252 | SEQ ID 3261 | CCCCAGTGCCACTTCTGA | 1.77 |
| SEQ ID 1634 | COMP ID 1634 | GGTCAGAAGTGGCACTGG | | | 6237 | 6254 | SEQ ID 3262 | CCAGTGCCACTTCTGACC | 1.03 |
| SEQ ID 1635 | COMP ID 1635 | CAGGTCAGAAGTGGCACT | | | 6239 | 6256 | SEQ ID 3263 | AGTGCCACTTCTGACCTG | 1.5 |
| SEQ ID 1636 | COMP ID 1636 | GACAGGTCAGAAGTGGCA | | | 6241 | 6258 | SEQ ID 3264 | TGCCACTTCTGACCTGTC | 1.33 |
| SEQ ID 1637 | COMP ID 1637 | AGGACAGGTCAGAAGTGG | | | 6243 | 6260 | SEQ ID 3265 | CCACTTCTGACCTGTCCT | 1.75 |
| SEQ ID 1638 | COMP ID 1638 | AGAGGACAGGTCAGAAGT | | | 6245 | 6262 | SEQ ID 3266 | ACTTCTGACCTGTCCTCT | 1.75 |
| SEQ ID 1639 | COMP ID 1639 | AGAGAGGACAGGTCAGAA | | | 6247 | 6264 | SEQ ID 3267 | TTCTGACCTGTCCTCTCT | 2.2 |
| SEQ ID 1640 | COMP ID 1640 | GCAGAGAGGACAGGTCAG | | | 6249 | 6266 | SEQ ID 3268 | CTGACCTGTCCTCTCTGC | 1.36 |
| SEQ ID 1641 | COMP ID 1641 | AAGCAGAGAGGACAGGTC | | | 6251 | 6268 | SEQ ID 3269 | GACCTGTCCTCTCTGCTT | 1.35 |
| SEQ ID 1642 | COMP ID 1642 | GGAAGCAGAGAGGACAGG | | | 6253 | 6270 | SEQ ID 3270 | CCTGTCCTCTCTGCTTCC | 1.41 |
| SEQ ID 1643 | COMP ID 1643 | AGGGAAGCAGAGAGGACA | | | 6255 | 6272 | SEQ ID 3271 | TGTCCTCTCTGCTTCCCT | 1.51 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1644 | COMP ID 1644 | TGAGGGAAGCAGAGAGGA | | | 6257 | 6274 | SEQ ID 3272 | TCCTCTCTGCTTCCCTCA | 1.87 |
| SEQ ID 1645 | COMP ID 1645 | TGTGAGGGAAGCAGAGAG | | | 6259 | 6276 | SEQ ID 3273 | CTCTCTGCTTCCCTCACA | 1.55 |
| SEQ ID 1646 | COMP ID 1646 | CACATTTCACATCCCCCA | 1092 | 1109 | 6278 | 6295 | SEQ ID 3274 | TGGGGGATGTGAAATGTG | 0.93 |
| SEQ ID 1647 | COMP ID 1647 | GTCACATTTCACATCCCC | 1094 | 1111 | 6280 | 6297 | SEQ ID 3275 | GGGGATGTGAAATGTGAC | 1.29 |
| SEQ ID 1648 | COMP ID 1648 | ATGTCACATTTCACATCC | 1096 | 1113 | 6282 | 6299 | SEQ ID 3276 | GGATGTGAAATGTGACAT | 1.64 |
| SEQ ID 1649 | COMP ID 1649 | CCATGTCACATTTCACAT | 1098 | 1115 | 6284 | 6301 | SEQ ID 3277 | ATGTGAAATGTGACATGG | 1.52 |
| SEQ ID 1650 | COMP ID 1650 | CTCCATGTCACATTTCAC | 1100 | 1117 | 6286 | 6303 | SEQ ID 3278 | GTGAAATGTGACATGGAG | 1.44 |
| SEQ ID 1651 | COMP ID 1651 | ACCTCCATGTCACATTTC | 1102 | 1119 | 6288 | 6305 | SEQ ID 3279 | GAAATGTGACATGGAGGT | 1.54 |
| SEQ ID 1652 | COMP ID 1652 | TCACCTCCATGTCACATT | 1104 | 1121 | 6290 | 6307 | SEQ ID 3280 | AATGTGACATGGAGGTGA | 1.1 |
| SEQ ID 1653 | COMP ID 1653 | GCTCACCTCCATGTCACA | 1106 | 1123 | 6292 | 6309 | SEQ ID 3281 | TGTGACATGGAGGTGAGC | 0.93 |
| SEQ ID 1654 | COMP ID 1654 | CAGCTCACCTCCATGTCA | 1108 | 1125 | 6294 | 6311 | SEQ ID 3282 | TGACATGGAGGTGAGCTG | .21 |
| SEQ ID 1655 | COMP ID 1655 | GGGCAGCTCACCTCCATGT | 1110 | 1127 | 6296 | 6313 | SEQ ID 3283 | ACATGGAGGTGAGCTGCC | 0.93 |
| SEQ ID 1656 | COMP ID 1656 | TGGGCAGTCACCTCCAT | 1112 | 1129 | 6298 | 6315 | SEQ ID 3284 | ATGGAGGTGAGCTGCCCA | 1.04 |
| SEQ ID 1657 | COMP ID 1657 | TCTGGGCAGCTCACCTCC | 1114 | 1131 | 6300 | 6317 | SEQ ID 3285 | GGAGGTGAGCTGCCCAGA | 1.3 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1658 | COMP ID 1658 | CATCTGGGCAGCTCACCT | 1116 | 1133 | 6302 | 6319 | SEQ ID 3286 | AGGTGAGCTGCCCAGATG | 1.63 |
| SEQ ID 1659 | COMP ID 1659 | GCCATCTGGGCAGCTCAC | 1118 | 1135 | 6304 | 6321 | SEQ ID 3287 | GTGAGCTGCCCAGATGGC | 1.04 |
| SEQ ID 1660 | COMP ID 1660 | TAGCCATCTGGGCAGCTC | 1120 | 1137 | 6306 | 6323 | SEQ ID 3288 | GAGCTGCCCAGATGGCTA | 1.24 |
| SEQ ID 1661 | COMP ID 1661 | TATAGCCATCTGGGCAGC | 1122 | 1139 | 6308 | 6325 | SEQ ID 3289 | GCTGCCCAGATGGCTATA | 1.19 |
| SEQ ID 1662 | COMP ID 1662 | GGTATAGCCATCTGGGCA | 1124 | 1141 | 6310 | 6327 | SEQ ID 3290 | TGCCCAGATGGCTATACC | no data |
| SEQ ID 1663 | COMP ID 1663 | CAGGTATAGCCATCTGGG | 1126 | 1143 | 6312 | 6329 | SEQ ID 3291 | CCCAGATGGCTATACCTG | 1.15 |
| SEQ ID 1664 | COMP ID 1664 | AGCAGGTATAGCCATCTG | 1128 | 1145 | 6314 | 6331 | SEQ ID 3292 | CAGATGGCTATACCTGCT | 1.34 |
| SEQ ID 1665 | COMP ID 1665 | GCAGCAGGTATAGCCATC | 1130 | 1147 | 6316 | 6333 | SEQ ID 3293 | GATGGCTATACCTGCTGC | 1.15 |
| SEQ ID 1666 | COMP ID 1666 | CGGCAGCAGGTATAGCCA | 1132 | 1149 | 6318 | 6335 | SEQ ID 3294 | TGGCTATACCTGCTGCCG | 1.35 |
| SEQ ID 1667 | COMP ID 1667 | GACGGCAGCAGGTATAGC | 1134 | 1151 | 6320 | 6337 | SEQ ID 3295 | GCTATACCTGCTGCCGTC | 1.69 |
| SEQ ID 1668 | COMP ID 1668 | TAGACGGCAGCAGGTATA | 1136 | 1153 | 6322 | 6339 | SEQ ID 3296 | TATACCTGCTGCCGTCTA | 1.38 |
| SEQ ID 1669 | COMP ID 1669 | TGTAGACGGCAGCAGGTA | 1138 | 1155 | 6324 | 6341 | SEQ ID 3297 | TACCTGCTGCCGTCTACA | 1.68 |
| SEQ ID 1670 | COMP ID 1670 | ACTGTAGACGGGCAGCAGG | 1140 | 1157 | 6326 | 6343 | SEQ ID 3298 | CCTGCTGCCGTCTACAGT | 1.34 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1671 | COMP ID 1671 | CGACTGTAGACGGCAGCA | 1142 | 1159 | 6328 | 6345 | SEQ ID 3299 | TGCTGCCGTCTACAGTCG | 1.4 |
| SEQ ID 1672 | COMP ID 1672 | CCCGACTGTAGACGGCAG | 1144 | 1161 | 6330 | 6347 | SEQ ID 3300 | CTGCCGTCTACAGTCGGG | 1.22 |
| SEQ ID 1673 | COMP ID 1673 | CCCCCGACTGTAGACGGC | 1146 | 1163 | 6332 | 6349 | SEQ ID 3301 | GCCGTCTACAGTCGGGGG | 1.24 |
| SEQ ID 1674 | COMP ID 1674 | GGCCCCCGACTGTAGACG | 1148 | 1165 | 6334 | 6351 | SEQ ID 3302 | CGTCTACAGTCGGGGGCC | 1.28 |
| SEQ ID 1675 | COMP ID 1675 | CAGGCCCCCGACTGTAGA | 1150 | 1167 | 6336 | 6353 | SEQ ID 3303 | TCTACAGTCGGGGGCCTG | 1.47 |
| SEQ ID 1676 | COMP ID 1676 | CCCAGGCCCCCGACTGTA | 1152 | 1169 | 6338 | 6355 | SEQ ID 3304 | TACAGTCGGGGGCCTGGG | 1.16 |
| SEQ ID 1677 | COMP ID 1677 | GCCCCAGGCCCCCGACTG | 1154 | 1171 | 6340 | 6357 | SEQ ID 3305 | CAGTCGGGGGCCTGGGGC | 1.6 |
| SEQ ID 1678 | COMP ID 1678 | CAGCCCCAGGCCCCCGAC | 1156 | 1173 | 6342 | 6359 | SEQ ID 3306 | GTCGGGGGCCTGGGGCTG | 1.19 |
| SEQ ID 1679 | COMP ID 1679 | AGCAGCCCCAGGCCCCCG | 1158 | 1175 | 6344 | 6361 | SEQ ID 3307 | CGGGGGCCTGGGGCTGCT | 1.54 |
| SEQ ID 1680 | COMP ID 1680 | GCAGCAGCCCCAGGCCCC | 1160 | 1177 | 6346 | 6363 | SEQ ID 3308 | GGGGCCTGGGGCTGCTGC | 1.27 |
| SEQ ID 1681 | COMP ID 1681 | GGGCAGCAGCCCCAGGCC | 1162 | 1179 | 6348 | 6365 | SEQ ID 3309 | GGCCTGGGGCTGCTGCCC | 1.55 |
| SEQ ID 1682 | COMP ID 1682 | AAGGGCAGCAGCCCCAGG | 1164 | 1181 | 6350 | 6367 | SEQ ID 3310 | CCTGGGGCTGCTGCCCTT | 1.04 |
| SEQ ID 1683 | COMP ID 1683 | AAAAGGGCAGCAGCCCCA | 1166 | 1183 | 6352 | 6369 | SEQ ID 3311 | TGGGGCTGCTGCCCTTTT | 1.3 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1684 | COMP ID 1684 | GTAAAAGGGCAGCAGCCC | 1168 | 1185 | 6354 | 6371 | SEQ ID 3312 | GGGCTGCTGCCCTTTTAC | 1.6 |
| SEQ ID 1685 | COMP ID 1685 | GGGTAAAAGGGCAGCAGC | 1170 | 1187 | 6356 | 6373 | SEQ ID 3313 | GCTGCTGCCCTTTTACCC | 2.89 |
| SEQ ID 1686 | COMP ID 1686 | CTGGGTAAAAGGGCAGCA | 1172 | 1189 | 6358 | 6375 | SEQ ID 3314 | TGCTGCCCTTTTACCCAG | 2.6 |
| SEQ ID 1687 | COMP ID 1687 | ACCTGGGTAAAAGGGCAG | | | 6360 | 6377 | SEQ ID 3315 | CTGCCCTTTTACCCAGGT | 1.27 |
| SEQ ID 1688 | COMP ID 1688 | GTACCTGGGTAAAAGGGC | | | 6362 | 6379 | SEQ ID 3316 | GCCCTTTTACCCAGGTAC | 1.55 |
| SEQ ID 1689 | COMP ID 1689 | GGGTACCTGGGTAAAAGG | | | 6364 | 6381 | SEQ ID 3317 | CCTTTTACCCAGGTACCC | 2.16 |
| SEQ ID 1690 | COMP ID 1690 | CTGGGTACCTGGGTAAAA | | | 6366 | 6383 | SEQ ID 3318 | TTTTACCCAGGTACCCAG | 1.55 |
| SEQ ID 1691 | COMP ID 1691 | CCCTGGGTACCTGGGTAA | | | 6368 | 6385 | SEQ ID 3319 | TTACCCAGGTACCCAGGG | no data |
| SEQ ID 1692 | COMP ID 1692 | ACCCCTGGGTACCTGGGT | | | 6370 | 6387 | SEQ ID 3320 | ACCCAGGTACCCAGGGGT | 1.57 |
| SEQ ID 1693 | COMP ID 1693 | CCACCCCTGGGTACCTGG | | | 6372 | 6389 | SEQ ID 3321 | CCAGGTACCCAGGGGTGG | 1.09 |
| SEQ ID 1694 | COMP ID 1694 | CGCCACCCCTGGGTACCT | | | 6374 | 6391 | SEQ ID 3322 | AGGTACCCAGGGGTGGCG | 1.24 |
| SEQ ID 1695 | COMP ID 1695 | CCCGCCACCCCTGGGTAC | | | 6376 | 6393 | SEQ ID 3323 | GTACCCAGGGGTGGGGG | 1.28 |
| SEQ ID 1696 | COMP ID 1696 | CACCCGCCACCCCTGGGT | | | 6378 | 6395 | SEQ ID 3324 | ACCCAGGGGTGGCGGGTG | 1.24 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1697 | COMP ID 1697 | CCCACCCGCCACCCTGG | | | 6380 | 6397 | SEQ ID 3325 | CCAGGGGTGGCGGGTGGG | 1.21 |
| SEQ ID 1698 | COMP ID 1698 | CACCCACCCGCCACCCCT | | | 6382 | 6399 | SEQ ID 3326 | AGGGGTGGCGGGTGGGTG | 1.13 |
| SEQ ID 1699 | COMP ID 1699 | CCCACCCACCCGCCACCC | | | 6384 | 6401 | SEQ ID 3327 | GGGTGGGGGTGGGTGGG | 1.11 |
| SEQ ID 1700 | COMP ID 1700 | AGCCCACCCACCCGCCAC | | | 6386 | 6403 | SEQ ID 3328 | GTGCGGGTGGGTGGGCT | 0.97 |
| SEQ ID 1701 | COMP ID 1701 | TCAGCCCACCCACCCGCC | | | 6388 | 6405 | SEQ ID 3329 | GGCGGTGGGTGGGCTGA | 1.16 |
| SEQ ID 1702 | COMP ID 1702 | GCTCAGCCCACCCACCCG | | | 6390 | 6407 | SEQ ID 3330 | CGGGTGGGTGGGCTGAGC | 0.99 |
| SEQ ID 1703 | COMP ID 1703 | GTGCTCAGCCCACCCACC | | | 6392 | 6409 | SEQ ID 3331 | GGTGGGTGGGCTGAGCAC | 1.24 |
| SEQ ID 1704 | COMP ID 1704 | CTGTGCTCAGCCCACCCA | | | 6394 | 6411 | SEQ ID 3332 | TGGGTGGGCTGAGCACAG | 1.54 |
| SEQ ID 1705 | COMP ID 1705 | CACTGTGCTCAGCCCACC | | | 6396 | 6413 | SEQ ID 3333 | GGTGGGCTGAGCACAGTG | 1.04 |
| SEQ ID 1706 | COMP ID 1706 | CACACTGTGCTCAGCCCA | | | 6398 | 6415 | SEQ ID 3334 | TGGGCTGAGCACAGTGTG | 1.37 |
| SEQ ID 1707 | COMP ID 1707 | GCCACACTGTGCTCAGCC | | | 6400 | 6417 | SEQ ID 3335 | GGCTGAGCACAGTGTGGC | 1.7 |
| SEQ ID 1708 | COMP ID 1708 | CTGCCACACTGTGCTCAG | | | 6402 | 6419 | SEQ ID 3336 | CTGAGCACAGTGTGGCAG | 1.54 |
| SEQ ID 1709 | COMP ID 1709 | GCCTGCCACACTGTGCTC | | | 6404 | 6421 | SEQ ID 3337 | GAGCACAGTGTGGCAGGC | 1.66 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1710 | COMP ID 1710 | CTGCCTGCCACACTGC | | | 6406 | 6423 | SEQ ID 3338 | GCACAGTGTGGCAGGCAG | 1.77 |
| SEQ ID 1711 | COMP ID 1711 | GGCTGCCTGCCACACTGT | | | 6408 | 6425 | SEQ ID 3339 | ACAGTGTGGCAGGCAGCC | 1.54 |
| SEQ ID 1712 | COMP ID 1712 | GGGCCCGGCTGCCTGCCA | | | 6414 | 6431 | SEQ ID 3340 | TGGCAGGCAGCCGGGCCC | 1.76 |
| SEQ ID 1713 | COMP ID 1713 | TGGGGCCCGGCTGCCTGC | | | 6416 | 6433 | SEQ ID 3341 | GCAGGCAGCCGGGCCCCA | no data |
| SEQ ID 1714 | COMP ID 1714 | ACTGGGGCCCGGCTGCCT | | | 6418 | 6435 | SEQ ID 3342 | AGGCAGCCGGGCCCCAGT | 2.55 |
| SEQ ID 1715 | COMP ID 1715 | GCACTGGGGCCCGGCTGC | | | 6420 | 6437 | SEQ ID 3343 | GCAGCCGGGCCCCAGTGC | 2.04 |
| SEQ ID 1716 | COMP ID 1716 | GGGCACTGGGGCCCGGCT | | | 6422 | 6439 | SEQ ID 3344 | AGCCGGGCCCCAGTGCCC | 1.25 |
| SEQ ID 1717 | COMP ID 1717 | GTGGGCACTGGGGCCCGG | | | 6424 | 6441 | SEQ ID 3345 | CCGGGCCCCAGTGCCCAC | 1.68 |
| SEQ ID 1718 | COMP ID 1718 | AGGTGGGCACTGGGGCCC | | | 6426 | 6443 | SEQ ID 3346 | GGGCCCCAGTGCCCACCT | 1.58 |
| SEQ ID 1719 | COMP ID 1719 | GCAGGTGGGCACTGGGGC | | | 6428 | 6445 | SEQ ID 3347 | GCCCCAGTGCCCACCTGC | 3.33 |
| SEQ ID 1720 | COMP ID 1720 | GGGCAGGTGGGCACTGGG | | | 6430 | 6447 | SEQ ID 3348 | CCCAGTGCCCACCTGCCC | 2.92 |
| SEQ ID 1721 | COMP ID 1721 | AAGGGCAGGTGGGCACTG | | | 6432 | 6449 | SEQ ID 3349 | CAGTGCCCACCTGCCCTT | 2.69 |
| SEQ ID 1722 | COMP ID 1722 | AGAAGGGCAGGTGGGCAC | | | 6434 | 6451 | SEQ ID 3350 | GTGCCCACCTGCCCTTCT | 3.06 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1723 | COMP ID 1723 | GAAGAAGGGCAGGTGGGC | | | 6436 | 6453 | SEQ ID 3351 | GCCCACCTGCCCTTCTTC | 2.88 |
| SEQ ID 1724 | COMP ID 1724 | ATGAAGAAGGGCAGGTGG | | | 6438 | 6455 | SEQ ID 3352 | CCACCTGCCCTTCTTCAT | 3.3 |
| SEQ ID 1725 | COMP ID 1725 | AGATGAAGAAGGGCAGGT | | | 6440 | 6457 | SEQ ID 3353 | ACCTGCCCTTCTTCATCT | 2.64 |
| SEQ ID 1726 | COMP ID 1726 | GCAGATGAAGAAGGGCAG | | | 6442 | 6459 | SEQ ID 3354 | CTGCCCTTCTTCATCTGC | 1.71 |
| SEQ ID 1727 | COMP ID 1727 | GGGCAGATGAAGAAGGGC | | | 6444 | 6461 | SEQ ID 3355 | GCCCTTCTTCATCTGCCC | 2.62 |
| SEQ ID 1728 | COMP ID 1728 | TAGGGCAGATGAAGAAGG | | | 6446 | 6463 | SEQ ID 3356 | CCTTCTTCATCTGCCCTA | 1.99 |
| SEQ ID 1729 | COMP ID 1729 | GTCCTCCAGCACACAGC | 1190 | 1207 | 6465 | 6482 | SEQ ID 3357 | GCTGTGTGCTGTGAGGAC | 1.2 |
| SEQ ID 1730 | COMP ID 1730 | TGGTCCTCACAGCACACA | 1192 | 1209 | 6467 | 6484 | SEQ ID 3358 | TGTGTGCTGTGAGGACCA | 1.44 |
| SEQ ID 1731 | COMP ID 1731 | TGTGGTCCTCACAGCACA | 1194 | 1211 | 6469 | 6486 | SEQ ID 3359 | TGTGCTGTGAGGACCACA | 1.75 |
| SEQ ID 1732 | COMP ID 1732 | TATGTGGTCCTCACAGCA | 1196 | 1213 | 6471 | 6488 | SEQ ID 3360 | TGCTGTGAGGACCACATA | 1.61 |
| SEQ ID 1733 | COMP ID 1733 | TGTATGTGGTCCTCACAG | 1198 | 1215 | 6473 | 6490 | SEQ ID 3361 | CTGTGAGGACCACATACA | 2.24 |
| SEQ ID 1734 | COMP ID 1734 | AGTGTATGTGGTCCTCAC | 1200 | 1217 | 6475 | 6492 | SEQ ID 3362 | GTGTGAGGACCACATACT | 2.42 |
| SEQ ID 1735 | COMP ID 1735 | GCAGTGTATGTGGTCCTC | 1202 | 1219 | 6477 | 6494 | SEQ ID 3363 | GAGGACCACATACACTGC | 2.48 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1736 | COMP ID 1736 | CAGCAGTGTATGTGGTCC | 1204 | 1221 | 6479 | 6496 | SEQ ID 3364 | GGACCACATACACTGCTG | 2.26 |
| SEQ ID 1737 | COMP ID 1737 | GACAGCAGTGTATGTGGT | 1206 | 1223 | 6481 | 6498 | SEQ ID 3365 | ACCACATACACTGCTGTC | 1.63 |
| SEQ ID 1738 | COMP ID 1738 | GGGACAGCAGTGTATGTG | 1208 | 1225 | 6483 | 6500 | SEQ ID 3366 | CACATACACTGCTGTCCC | 2.73 |
| SEQ ID 1739 | COMP ID 1739 | GCCGGGACAGCAGTGTATG | 1210 | 1227 | 6485 | 6502 | SEQ ID 3367 | CATACACTGCTGTCCCGC | 1.46 |
| SEQ ID 1740 | COMP ID 1740 | CCGCGGGACAGCAGTGTA | 1212 | 1229 | 6487 | 6504 | SEQ ID 3368 | TACACTGCTGTCCCGCGG | 1.42 |
| SEQ ID 1741 | COMP ID 1741 | CCCCGCGGGACAGCAGTG | 1214 | 1231 | 6489 | 6506 | SEQ ID 3369 | CACTGCTGTCCCGCGGGG | 1.69 |
| SEQ ID 1742 | COMP ID 1742 | AACCCCGCGGGACAGCAG | 1216 | 1233 | 6491 | 6508 | SEQ ID 3370 | CTGCTGTCCCGCGGGGTT | 1.91 |
| SEQ ID 1743 | COMP ID 1743 | TAAACCCCGCGGGACAGC | 1218 | 1235 | 6493 | 6510 | SEQ ID 3371 | GCTGTCCCGCGGGGTTTA | 1.31 |
| SEQ ID 1744 | COMP ID 1744 | CGTAAACCCCGCGGGACA | 1220 | 1237 | 6495 | 6512 | SEQ ID 3372 | TGTCCCGCGGGGTTTACG | no data |
| SEQ ID 1745 | COMP ID 1745 | CACGTAAACCCCGCGGGA | 1222 | 1239 | 6497 | 6514 | SEQ ID 3373 | TCCCGCGGGGTTTACGTG | no data |
| SEQ ID 1746 | COMP ID 1746 | CACACGTAAACCCCGCGG | 1224 | 1241 | 6499 | 6516 | SEQ ID 3374 | CCGCGGGGTTTACGTGTG | no data |
| SEQ ID 1747 | COMP ID 1747 | GTCACACGTAAACCCCGC | 1226 | 1243 | 6501 | 6518 | SEQ ID 3375 | GCGGGGTTTACGTGTGAC | no data |
| SEQ ID 1748 | COMP ID 1748 | GTGTCACACGTAAACCCC | 1228 | 1245 | 6503 | 6520 | SEQ ID 3376 | GGGGTTTACGTGTGACAC | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1749 | COMP ID 1749 | GCGTGTCACGTAAACC | 1230 | 1247 | 6505 | 6522 | SEQ ID 3377 | GGTTTACGTGTGACACGC | no data |
| SEQ ID 1750 | COMP ID 1750 | CTGCGTGTCACACGTAAA | 1232 | 1249 | 6507 | 6524 | SEQ ID 3378 | TTTACGTGTGACACGCAG | no data |
| SEQ ID 1751 | COMP ID 1751 | TTCTGCGTGTCACACGTA | 1234 | 1251 | 6509 | 6526 | SEQ ID 3379 | TACGTGTGACACGCAGAA | no data |
| SEQ ID 1752 | COMP ID 1752 | CCTTCTGCGTGTCACACG | 1236 | 1253 | 6511 | 6528 | SEQ ID 3380 | CGTGTGACACGCAGAAGG | no data |
| SEQ ID 1753 | COMP ID 1753 | ACCCTTCTGCGTGTCACA | 1238 | 1255 | 6513 | 6530 | SEQ ID 3381 | TGTGACACGCAGAAGGGT | no data |
| SEQ ID 1754 | COMP ID 1754 | GTACCCTTCTGCGTGTCA | 1240 | 1257 | 6515 | 6532 | SEQ ID 3382 | TGACACGCAGAAGGGTAC | no data |
| SEQ ID 1755 | COMP ID 1755 | AGGTACCCTTCTGCGTGT | 1242 | 1259 | 6517 | 6534 | SEQ ID 3383 | ACACGCAGAAGGGTACCT | no data |
| SEQ ID 1756 | COMP ID 1756 | ACAGGTACCCTTCTGCGT | 1244 | 1261 | 6519 | 6536 | SEQ ID 3384 | ACGCAGAAGGGTACCTGT | no data |
| SEQ ID 1757 | COMP ID 1757 | TCACAGGTACCCTTCTGC | 1246 | 1263 | 6521 | 6538 | SEQ ID 3385 | GCAGAAGGGTACCTGTGA | no data |
| SEQ ID 1758 | COMP ID 1758 | GTTCACAGGTACCCTTCT | 1248 | 1265 | 6523 | 6540 | SEQ ID 3386 | AGAAGGGTACCTGTGAAC | no data |
| SEQ ID 1759 | COMP ID 1759 | CTGTTCACAGGTACCCTT | 1250 | 1267 | 6525 | 6542 | SEQ ID 3387 | AAGGGTACCTGTGAACAG | no data |
| SEQ ID 1760 | COMP ID 1760 | CCCTGTTCACAGGTACCC | 1252 | 1269 | 6527 | 6544 | SEQ ID 3388 | GGGTACCTGTGAACAGGG | no data |
| SEQ ID 1761 | COMP ID 1761 | GCCCCTGTTCACAGGTAC | 1254 | 1271 | 6529 | 6546 | SEQ ID 3389 | GTACCTGTGAACAGGGGC | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Position Sequence ID | Target Site Sequence | Relative Progranulin expression (Relative to PBS) |
|---|---|---|---|---|---|---|---|---|---|
| SEQ ID 1762 | COMP ID 1762 | GGGCCCCTGTTCACAGT | 1256 | 1273 | 6531 | 6548 | SEQ ID 3390 | ACCTGTGAACAGGGGCCCC | 1.64 |
| SEQ ID 1763 | COMP ID 1763 | TGGGGCCCCTGTTCACAG | 1258 | 1275 | 6533 | 6550 | SEQ ID 3391 | CTGTGAACAGGGGCCCCA | 1.48 |
| SEQ ID 1764 | COMP ID 1764 | GGTGGGGCCCCTGTTCAC | 1260 | 1277 | 6535 | 6552 | SEQ ID 3392 | GTGAACAGGGGCCCCACC | 1.51 |
| SEQ ID 1765 | COMP ID 1765 | CTGGTGGGGCCCCTGTTC | 1262 | 1279 | 6537 | 6554 | SEQ ID 3393 | GAACAGGGGCCCCACCAG | 1.9 |
| SEQ ID 1766 | COMP ID 1766 | ACCTGGTGGGGCCCCTGT | 1264 | 1281 | 6539 | 6556 | SEQ ID 3394 | ACAGGGGCCCCACCAGGT | 2.02 |
| SEQ ID 1767 | COMP ID 1767 | GCACCTGGTGGGGCCCCT | 1266 | 1283 | 6541 | 6558 | SEQ ID 3395 | AGGGGCCCCACCAGGTGC | 2.13 |
| SEQ ID 1768 | COMP ID 1768 | GGGCACCTGGTGGGGCCC | 1268 | 1285 | 6543 | 6560 | SEQ ID 3396 | GGGCCCCACCAGGTGCCC | 1.76 |
| SEQ ID 1769 | COMP ID 1769 | CAGGGCACCTGGTGGGGC | 1270 | 1287 | 6545 | 6562 | SEQ ID 3397 | GCCCCACCAGGTGCCCTG | 1.91 |
| SEQ ID 1770 | COMP ID 1770 | TCCAGGGCACCTGGTGGG | 1272 | 1289 | 6547 | 6564 | SEQ ID 3398 | CCCACCAGGTGCCCTGGA | 1.51 |
| SEQ ID 1771 | COMP ID 1771 | CATCCAGGGCACCTGGTG | 1274 | 1291 | 6549 | 6566 | SEQ ID 3399 | CACCAGGTGCCCTGGATG | 1.55 |
| SEQ ID 1772 | COMP ID 1772 | TCCATCCAGGGCACCTGG | 1276 | 1293 | 6551 | 6568 | SEQ ID 3400 | CCAGGTGCCCTGGATGGA | 1.34 |
| SEQ ID 1773 | COMP ID 1773 | TCTCCATCCAGGGCACCT | 1278 | 1295 | 6553 | 6570 | SEQ ID 3401 | AGGTGCCCTGGATGGAGA | 1.65 |
| SEQ ID 1774 | COMP ID 1774 | CTTCTCCATCCAGGGCAC | 1280 | 1297 | 6555 | 6572 | SEQ ID 3402 | GTGCCCTGGATGGAGAAG | 1.29 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | End Position | Precursor-mRNA Position (SEQ ID NO 3949) Start Position | End Position | Target Site Sequence ID | Target Site Sequence | Relative Progranulin expression (Relative to PBS) |
|---|---|---|---|---|---|---|---|---|---|
| SEQ ID 1775 | COMP ID 1775 | GCCTTCTCCATCCAGGGC | 1282 | 1299 | 6557 | 6574 | SEQ ID 3403 | GCCCTGGATGGAGAAGGC | 1.6 |
| SEQ ID 1776 | COMP ID 1776 | GGGCCTTCTCCATCCAGG | 1284 | 1301 | 6559 | 6576 | SEQ ID 3404 | CCTGGATGGAGAAGGCCC | 1.54 |
| SEQ ID 1777 | COMP ID 1777 | TGGGGCCTTCTCCATCCA | 1286 | 1303 | 6561 | 6578 | SEQ ID 3405 | TGGATGGAGAAGGCCCCA | 1.32 |
| SEQ ID 1778 | COMP ID 1778 | GCTGGGGCCTTCTCCATC | 1288 | 1305 | 6563 | 6580 | SEQ ID 3406 | GATGGAGAAGGCCCCAGC | 1.29 |
| SEQ ID 1779 | COMP ID 1779 | GAGCTGGGGCCTTCTCCA | 1290 | 1307 | 6565 | 6582 | SEQ ID 3407 | TGGAGAAGGCCCCAGCTC | 1.68 |
| SEQ ID 1780 | COMP ID 1780 | GTGAGCTGGGGCCTTCTC | 1292 | 1309 | 6567 | 6584 | SEQ ID 3408 | GAGAAGGCCCCAGCTCAC | 2.12 |
| SEQ ID 1781 | COMP ID 1781 | AGGTGAGCTGGGGCCTTC | 1294 | 1311 | 6569 | 6586 | SEQ ID 3409 | GAAGGCCCCAGCTCACCT | 2.3 |
| SEQ ID 1782 | COMP ID 1782 | TGAGGTGAGCTGGGGCCT | 1296 | 1313 | 6571 | 6588 | SEQ ID 3410 | AGGCCCCAGCTCACCTCA | 1.88 |
| SEQ ID 1783 | COMP ID 1783 | GCTGAGGTGAGCTGGGGC | 1298 | 1315 | 6573 | 6590 | SEQ ID 3411 | GCCCCAGCTCACCTCAGC | 2.3 |
| SEQ ID 1784 | COMP ID 1784 | AGGCTGAGGTGAGCTGGG | 1300 | 1317 | 6575 | 6592 | SEQ ID 3412 | CCCAGCTCACCTCAGCCT | 2.25 |
| SEQ ID 1785 | COMP ID 1785 | GCAGGCTGAGGTGAGCTG | 1302 | 1319 | 6577 | 6594 | SEQ ID 3413 | CAGCTCACCTCAGCCTGC | 1.51 |
| SEQ ID 1786 | COMP ID 1786 | TGGCAGGCTGAGGTGAGC | 1304 | 1321 | 6579 | 6596 | SEQ ID 3414 | GCTCACCTCAGCCTGCCA | 1.59 |
| SEQ ID 1787 | COMP ID 1787 | TCTGGCAGGCTGAGGTGA | 1306 | 1323 | 6581 | 6598 | SEQ ID 3415 | TCACCTCAGCCTGCCAGA | 1.82 |
| SEQ ID 1788 | COMP ID 1788 | GGTCTGGCAGGCTGAGGT | 1308 | 1325 | 6583 | 6600 | SEQ ID 3416 | ACCTCAGCCTGCCAGACC | 1.48 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | End Position | Precursor-mRNA Position (SEQ ID NO 3949) Start Position | End Position | Target Site Sequence ID | Target Site Sequence | Relative Progranulin expression (Relative to PBS) |
|---|---|---|---|---|---|---|---|---|---|
| SEQ ID 1789 | COMP ID 1789 | TGGGTCTCTGCAGGCTGAG | 1310 | 1327 | 6585 | 6602 | SEQ ID 3417 | CTCAGCCTGCCAGACCCA | 1.69 |
| SEQ ID 1790 | COMP ID 1790 | TGTGGGTCTCTGGCAGGCTG | 1312 | 1329 | 6587 | 6604 | SEQ ID 3418 | CAGCCTGCCAGACCCACA | 1.49 |
| SEQ ID 1791 | COMP ID 1791 | CTTGTGGGTCTCTGCAGGC | 1314 | 1331 | 6589 | 6606 | SEQ ID 3419 | GCCTGCCAGACCCACAAG | 1.6 |
| SEQ ID 1792 | COMP ID 1792 | GGCTTGTGGGTCTCGGCAG | 1316 | 1333 | 6591 | 6608 | SEQ ID 3420 | CTGCCAGACCCACAAGCC | 1.76 |
| SEQ ID 1793 | COMP ID 1793 | AAGGCTTGTGGGTCTCGGC | 1318 | 1335 | 6593 | 6610 | SEQ ID 3421 | GCCAGACCCACAAGCCTT | 1.3 |
| SEQ ID 1794 | COMP ID 1794 | TCAAGGCTTGTGGGTCTG | 1320 | 1337 | 6595 | 6612 | SEQ ID 3422 | CAGACCCACAAGCCTTGA | 1.81 |
| SEQ ID 1795 | COMP ID 1795 | CTTCAAGGCTTGTGGGTC | 1322 | 1339 | 6597 | 6614 | SEQ ID 3423 | GACCCACAAGCCTTGAAG | 1.75 |
| SEQ ID 1796 | COMP ID 1796 | CTCTTCAAGGCTTGTGGG | 1324 | 1341 | 6599 | 6616 | SEQ ID 3424 | CCCACAAGCCTTGAAGAG | 1.5 |
| SEQ ID 1797 | COMP ID 1797 | CTCTCTTCAAGGCTTGTG | 1326 | 1343 | 6601 | 6618 | SEQ ID 3425 | CACAAGCCTTGAAGAGAG | 1.4 |
| SEQ ID 1798 | COMP ID 1798 | ATCTCTCTTCAAGGCTTG | 1328 | 1345 | 6603 | 6620 | SEQ ID 3426 | CAAGCCTTGAAGAGAGAT | 1.39 |
| SEQ ID 1799 | COMP ID 1799 | ACATCTCTCTTCAAGGCT | 1330 | 1347 | 6605 | 6622 | SEQ ID 3427 | AGCCTTGAAGAGAGATGT | 1.15 |
| SEQ ID 1800 | COMP ID 1800 | GGACATCTCTCTTCAAGG | 1332 | 1349 | 6607 | 6624 | SEQ ID 3428 | CCTTGAAGAGAGATGTCC | 1.66 |
| SEQ ID 1801 | COMP ID 1801 | GGGGACATCTCTCTTCAA | 1334 | 1351 | 6609 | 6626 | SEQ ID 3429 | TTGAAGAGAGATGTCCCC | 1.66 |
| SEQ ID 1802 | COMP ID 1802 | CAGGGGACATCTCTCTTC | 1336 | 1353 | 6611 | 6628 | SEQ ID 3430 | GAAGAGAGATGTCCCTG | 1.76 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1803 | COMP ID 1803 | CACAGGGGACATCTCT | 1338 | 1355 | 6613 | 6630 | SEQ ID 3431 | AGAGAGATGTCCCCTGTG | 1.48 |
| SEQ ID 1804 | COMP ID 1804 | ATCACAGGGGACATCTCT | 1340 | 1357 | 6615 | 6632 | SEQ ID 3432 | AGAGATGTCCCCTGTGAT | 2.37 |
| SEQ ID 1805 | COMP ID 1805 | TTATCAGGGGACATCT | 1342 | 1359 | 6617 | 6634 | SEQ ID 3433 | AGATGTCCCCTGTGATAA | 2.41 |
| SEQ ID 1806 | COMP ID 1806 | CATTATCACAGGGGACAT | 1344 | 1361 | 6619 | 6636 | SEQ ID 3434 | ATGTCCCCTGTGATAATG | 1.94 |
| SEQ ID 1807 | COMP ID 1807 | GACATTATCACAGGGGAC | 1346 | 1363 | 6621 | 6638 | SEQ ID 3435 | GTCCCCTGTGATAATGTC | 2.18 |
| SEQ ID 1808 | COMP ID 1808 | CTGACATTATCACAGGGG | 1348 | 1365 | 6623 | 6640 | SEQ ID 3436 | CCCCTGTGATAATGTCAG | 2.28 |
| SEQ ID 1809 | COMP ID 1809 | TGCTGACATTATCACAGG | 1350 | 1367 | 6625 | 6642 | SEQ ID 3437 | CCTGTGATAATGTCAGCA | 1.89 |
| SEQ ID 1810 | COMP ID 1810 | GCTGCTGACATTATCACA | 1352 | 1369 | 6627 | 6644 | SEQ ID 3438 | TGTGATAATGTCAGCAGC | 1.14 |
| SEQ ID 1811 | COMP ID 1811 | CAGCTGCTGACATTATCA | 1354 | 1371 | 6629 | 6646 | SEQ ID 3439 | TGATAATGTCAGCAGCTG | 1.63 |
| SEQ ID 1812 | COMP ID 1812 | GACAGCTGCTGACATTAT | 1356 | 1373 | 6631 | 6648 | SEQ ID 3440 | ATAATGTCAGCAGCTGTC | 1.59 |
| SEQ ID 1813 | COMP ID 1813 | GGGACAGCTGCTGACATT | 1358 | 1375 | 6633 | 6650 | SEQ ID 3441 | AATGTCAGCAGCTGTCCC | 2.5 |
| SEQ ID 1814 | COMP ID 1814 | GAGGGACAGCTGCTGACA | 1360 | 1377 | 6635 | 6652 | SEQ ID 3442 | TGTCAGCAGCTGTCCCTC | 2.06 |
| SEQ ID 1815 | COMP ID 1815 | AGGAGGGACAGCTGCTGA | 1362 | 1379 | 6637 | 6654 | SEQ ID 3443 | TCAGCAGCTGTCCCTCCT | 2.87 |
| SEQ ID 1816 | COMP ID 1816 | GGAGGAGGGACAGCTGCT | 1364 | 1381 | 6639 | 6656 | SEQ ID 3444 | AGCAGCTGTCCCTCCTCC | 1.89 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1817 | COMP ID 1817 | TCGGAGGAGGGACAGCTG | 1366 | 1383 | 6641 | 6658 | SEQ ID 3445 | CAGCTGTCCCTCCTCCGA | 1.93 |
| SEQ ID 1818 | COMP ID 1818 | TATCGGAGGAGGGACAGC | 1368 | 1385 | 6643 | 6660 | SEQ ID 3446 | GCTGTCCCTCCTCCGATA | 2.12 |
| SEQ ID 1819 | COMP ID 1819 | GGTATCGGAGGAGGGACA | 1370 | 1387 | 6645 | 6662 | SEQ ID 3447 | TGTCCCTCCTCCGATACC | 2.22 |
| SEQ ID 1820 | COMP ID 1820 | CAGGTATCGGAGGAGGGA | 1372 | 1389 | 6647 | 6664 | SEQ ID 3448 | TCCCTCCTCCGATACCTG | 2.55 |
| SEQ ID 1821 | COMP ID 1821 | AGCAGGTATCGGAGGAGG | 1374 | 1391 | 6649 | 6666 | SEQ ID 3449 | CCTCCTCCGATACCTGCT | 2.39 |
| SEQ ID 1822 | COMP ID 1822 | GCAGCAGGTATCGGAGGA | 1376 | 1393 | 6651 | 6668 | SEQ ID 3450 | TCCTCCGATACCTGCTGC | 2.06 |
| SEQ ID 1823 | COMP ID 1823 | TGGCAGCAGGTATCGGAG | 1378 | 1395 | 6653 | 6670 | SEQ ID 3451 | CTCCGATACCTGCTGCCA | 1.88 |
| SEQ ID 1824 | COMP ID 1824 | GTTGGCAGCAGGTATCGG | 1380 | 1397 | 6655 | 6672 | SEQ ID 3452 | CCGATACCTGCTGCCAAC | 1.92 |
| SEQ ID 1825 | COMP ID 1825 | GAGTTGGCAGCAGGTATC | 1382 | 1399 | 6657 | 6674 | SEQ ID 3453 | GATACCTGCTGCCAACTC | 1.48 |
| SEQ ID 1826 | COMP ID 1826 | GTGAGTTGGCAGCAGGTA | 1384 | 1401 | 6659 | 6676 | SEQ ID 3454 | TACCTGCTGCCAACTCAC | 1.14 |
| SEQ ID 1827 | COMP ID 1827 | ACGTGAGTTGGCAGCAGG | 1386 | 1403 | 6661 | 6678 | SEQ ID 3455 | CCTGCTGCCAACTCACGT | no data |
| SEQ ID 1828 | COMP ID 1828 | AGACGTGAGTTGGCAGCA | 1388 | 1405 | 6663 | 6680 | SEQ ID 3456 | TGCTGCCAACTCACGTCT | no data |
| SEQ ID 1829 | COMP ID 1829 | CCAGACGTGAGTTGGCAG | 1390 | 1407 | 6665 | 6682 | SEQ ID 3457 | CTGCCAACTCACGTCTGG | no data |
| SEQ ID 1830 | COMP ID 1830 | CCCCAGACGTGAGTTGGC | 1392 | 1409 | 6667 | 6684 | SEQ ID 3458 | GCCAACTCACGTCTGGGG | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) Position End | Target Site Sequence ID | Target Site Sequence | Relative Progranulin expression (Relative to PBS) |
|---|---|---|---|---|---|---|---|---|---|
| SEQ ID 1831 | COMP ID 1831 | CTCCCCAGACGTGAGTTG | 1394 | 1411 | 6669 | 6686 | SEQ ID 3459 | CAACTCACGTCTGGGGAG | no data |
| SEQ ID 1832 | COMP ID 1832 | CACTCCCAGACGTGAGT | 1396 | 1413 | 6671 | 6688 | SEQ ID 3460 | ACTCACGTCTGGGAGTG | 1.67 |
| SEQ ID 1833 | COMP ID 1833 | CCCACTCCCCAGACGTGA | 1398 | 1415 | 6673 | 6690 | SEQ ID 3461 | TCACGTCTGGGGAGTGGG | 1.7 |
| SEQ ID 1834 | COMP ID 1834 | GCCCCACTCCCCAGACGT | 1400 | 1417 | 6675 | 6692 | SEQ ID 3462 | ACGTCTGGGGAGTGGGGC | no data |
| SEQ ID 1835 | COMP ID 1835 | CAGCCCCACTCCCCAGAC | 1402 | 1419 | 6677 | 6694 | SEQ ID 3463 | GTCTGGGGAGTGGGGCTG | no data |
| SEQ ID 1836 | COMP ID 1836 | AGCAGCCCCACTCCCCAG | 1404 | 1421 | 6679 | 6696 | SEQ ID 3464 | CTGGGGAGTGGGGCTGCT | 1.34 |
| SEQ ID 1837 | COMP ID 1837 | ACAGCAGCCCCACTCCCC | 1406 | 1423 | 6681 | 6698 | SEQ ID 3465 | GGGGAGTGGGGCTGCTGT | 1.38 |
| SEQ ID 1838 | COMP ID 1838 | GGACAGCAGCCCCACTCC | 1408 | 1425 | 6683 | 6700 | SEQ ID 3466 | GGAGTGGGGCTGCTGTCC | 1.63 |
| SEQ ID 1839 | COMP ID 1839 | TTGGACAGCAGCCCCACT | 1410 | 1427 | 6685 | 6702 | SEQ ID 3467 | AGTGGGGCTGCTGTCCAA | 1.72 |
| SEQ ID 1840 | COMP ID 1840 | GATTGGACAGCAGCCCCA | 1412 | 1429 | 6687 | 6704 | SEQ ID 3468 | TGGGGCTGCTGTCCAATC | 1.58 |
| SEQ ID 1841 | COMP ID 1841 | GGGATTGGACAGCAGCCC | 1414 | 1431 | 6689 | 6706 | SEQ ID 3469 | GGGCTGCTGTCCAATCCC | no data |
| SEQ ID 1842 | COMP ID 1842 | CTGGGATTGGACAGCAGC | 1416 | 1433 | 6691 | 6708 | SEQ ID 3470 | GCTGCTGTCCAATCCCAG | no data |
| SEQ ID 1843 | COMP ID 1843 | CTCTGGGATTGGACAGCA | 1418 | 1435 | 6693 | 6710 | SEQ ID 3471 | TGCTGTCCAATCCCAGAG | no data |
| SEQ ID 1844 | COMP ID 1844 | GCTGTCCCTCCCATATA | | | 6712 | 6729 | SEQ ID 3472 | TATATGGAGGGGACAGC | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1845 | COMP ID 1845 | ATGCTGTCCCTCCCATA | | | 6714 | 6731 | SEQ ID 3473 | TATGGAGGGACAGCAT | no data |
| SEQ ID 1846 | COMP ID 1846 | AGATGCTGTCCCCTCCA | | | 6716 | 6733 | SEQ ID 3474 | TGGGAGGGGACAGCATCT | no data |
| SEQ ID 1847 | COMP ID 1847 | CAAGATGCTGTCCCCTCC | | | 6718 | 6735 | SEQ ID 3475 | GGAGGGGACAGCATCTTG | no data |
| SEQ ID 1848 | COMP ID 1848 | GCCAAGATGCTGTCCCT | | | 6720 | 6737 | SEQ ID 3476 | AGGGGACAGCATCTTGGC | no data |
| SEQ ID 1849 | COMP ID 1849 | AGGCCAAGATGCTGTCCC | | | 6722 | 6739 | SEQ ID 3477 | GGGACAGCATCTTGGCCT | no data |
| SEQ ID 1850 | COMP ID 1850 | CCAGGCCAAGATGCTGTC | | | 6724 | 6741 | SEQ ID 3478 | GACAGCATCTTGGCCTGG | no data |
| SEQ ID 1851 | COMP ID 1851 | GCCCAGGCCAAGATGCTG | | | 6726 | 6743 | SEQ ID 3479 | CAGCATCTTGGCCTGGGC | no data |
| SEQ ID 1852 | COMP ID 1852 | CTGCCCAGGCCAAGATGC | | | 6728 | 6745 | SEQ ID 3480 | GCATCTTGGCCTGGGCAG | no data |
| SEQ ID 1853 | COMP ID 1853 | ACCTGCCCAGGCCAAGAT | | | 6730 | 6747 | SEQ ID 3481 | ATCTTGGCCTGGGCAGGT | no data |
| SEQ ID 1854 | COMP ID 1854 | CCACCTGCCCAGGCCAAG | | | 6732 | 6749 | SEQ ID 3482 | CTTGGCCTGGGCAGGTGG | no data |
| SEQ ID 1855 | COMP ID 1855 | ACCCACCTGCCCAGGCCA | | | 6734 | 6751 | SEQ ID 3483 | TGGCCTGGGCAGGTGGGT | no data |
| SEQ ID 1856 | COMP ID 1856 | CCACCCACCTGCCCAGGC | | | 6736 | 6753 | SEQ ID 3484 | GCCTGGGCAGGTGGGTGG | no data |
| SEQ ID 1857 | COMP ID 1857 | GGCCACCCACCTGCCCAG | | | 6738 | 6755 | SEQ ID 3485 | CTGGGCAGGTGGGTGGCC | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1858 | COMP ID 1858 | TTGGCCACCCACCTGCCC | | | 6740 | 6757 | SEQ ID 3486 | GGGCAGGTGGGTGGCCAA | 1.32 |
| SEQ ID 1859 | COMP ID 1859 | GCTTGGCCACCCACCTGC | | | 6742 | 6759 | SEQ ID 3487 | GCAGGTGGGTGGCCAAGC | 1.18 |
| SEQ ID 1860 | COMP ID 1860 | GAGCTTGGCCACCCACCT | | | 6744 | 6761 | SEQ ID 3488 | AGGTGGGTGGCCAAGCTC | 1.25 |
| SEQ ID 1861 | COMP ID 1861 | AGCCACTATGTGGGCGC | | | 6880 | 6897 | SEQ ID 3489 | GCGCCCACATAGTGGCT | 1.14 |
| SEQ ID 1862 | COMP ID 1862 | GTAGCCACTATGTGGGGC | | | 6882 | 6899 | SEQ ID 3490 | GCCCCACATAGTGGCTAC | 2.07 |
| SEQ ID 1863 | COMP ID 1863 | AGGTAGCCACTATGTGGG | | | 6884 | 6901 | SEQ ID 3491 | CCCACATAGTGGCTACCT | 1.38 |
| SEQ ID 1864 | COMP ID 1864 | GTAGGTAGCCACTATGTG | | | 6886 | 6903 | SEQ ID 3492 | CACATAGTGGCTACCTAC | no data |
| SEQ ID 1865 | COMP ID 1865 | TTGTAGGTAGCCACTATG | | | 6888 | 6905 | SEQ ID 3493 | CATAGTGGCTACCTACAA | 1.38 |
| SEQ ID 1866 | COMP ID 1866 | CGTTGTAGGTAGCCACTA | | | 6890 | 6907 | SEQ ID 3494 | TAGTGGCTACCTACAACG | 1.72 |
| SEQ ID 1867 | COMP ID 1867 | GGCGTTGTAGGTAGCCAC | | | 6892 | 6909 | SEQ ID 3495 | GTGGCTACCTACAACGCC | no data |
| SEQ ID 1868 | COMP ID 1868 | AGGGCGTTGTAGGTAGCC | | | 6894 | 6911 | SEQ ID 3496 | GGCTACCTACAACGCCCT | 1.79 |
| SEQ ID 1869 | COMP ID 1869 | AAAGGGCGTTGTAGGTAG | | | 6896 | 6913 | SEQ ID 3497 | CTACCTACAACGCCCTTT | 1.45 |
| SEQ ID 1870 | COMP ID 1870 | GGAAAGGGCGTTGTAGGT | | | 6898 | 6915 | SEQ ID 3498 | ACCTACAACGCCCTTTCC | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1871 | COMP ID 1871 | CAGGAAAGGGCGTTGTAG | | | 6900 | 6917 | SEQ ID 3499 | CTACAACGCCCTTTCCTG | no data |
| SEQ ID 1872 | COMP ID 1872 | GGCAGGAAAGGGCGTTGT | | | 6902 | 6919 | SEQ ID 3500 | ACAACGCCCTTTCCTGCC | no data |
| SEQ ID 1873 | COMP ID 1873 | TGGGCAGGAAAGGGCGTT | | | 6904 | 6921 | SEQ ID 3501 | AACGCCCTTTCCTGCCCA | 1.9 |
| SEQ ID 1874 | COMP ID 1874 | GGTGGGCAGGAAAGGGCG | | | 6906 | 6923 | SEQ ID 3502 | CGCCCTTTCCTGCCCACC | no data |
| SEQ ID 1875 | COMP ID 1875 | GGGGTGGGCAGGAAAGGG | | | 6908 | 6925 | SEQ ID 3503 | CCCTTTCCTGCCCACCCC | no data |
| SEQ ID 1876 | COMP ID 1876 | GGGGGGTGGGCAGGAAAG | | | 6910 | 6927 | SEQ ID 3504 | CTTTCCTGCCCACCCCCC | no data |
| SEQ ID 1877 | COMP ID 1877 | CTGGGGGTGGGCAGGAA | | | 6912 | 6929 | SEQ ID 3505 | TTCCTGCCCACCCCCCAG | 2.53 |
| SEQ ID 1878 | COMP ID 1878 | GGTCCGAGCAGCAGACAG | 1437 | 1454 | 6931 | 6948 | SEQ ID 3506 | CTGTCTGCTGCTCGGACC | no data |
| SEQ ID 1879 | COMP ID 1879 | GTGGTCCGAGCAGCAGAC | 1439 | 1456 | 6933 | 6950 | SEQ ID 3507 | GTCTGCTGCTCGGACCAC | no data |
| SEQ ID 1880 | COMP ID 1880 | TGGTGGTCCGAGCAGCAG | 1441 | 1458 | 6935 | 6952 | SEQ ID 3508 | CTGCTGCTCGGACCACCA | 1.21 |
| SEQ ID 1881 | COMP ID 1881 | GCTGGTGGTCCGAGCAGC | 1443 | 1460 | 6937 | 6954 | SEQ ID 3509 | GCTGCTCGGACCACCAGC | no data |
| SEQ ID 1882 | COMP ID 1882 | GTGCTGGTGGTCCGAGCA | 1445 | 1462 | 6939 | 6956 | SEQ ID 3510 | TGCTCGGACCACCAGCAC | no data |
| SEQ ID 1883 | COMP ID 1883 | CAGTGCTGGTGGTCCGAG | 1447 | 1464 | 6941 | 6958 | SEQ ID 3511 | CTCGGACCACCAGCACTG | 1.79 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1884 | COMP ID 1884 | AGCAGTGCTGGTGTCCG | 1449 | 1466 | 6943 | 6960 | SEQ ID 3512 | CGGACACCAGCACTGCT | 1.64 |
| SEQ ID 1885 | COMP ID 1885 | GCAGCAGTGCTGGTGGTC | 1451 | 1468 | 6945 | 6962 | SEQ ID 3513 | GACCACCAGCACTGCTGC | no data |
| SEQ ID 1886 | COMP ID 1886 | GGGCAGCAGTGCTGGTGG | 1453 | 1470 | 6947 | 6964 | SEQ ID 3514 | CCACCAGCACTGCTGCCC | no data |
| SEQ ID 1887 | COMP ID 1887 | GGGGGCAGCAGTGCTGGT | 1455 | 1472 | 6949 | 6966 | SEQ ID 3515 | ACCAGCACTGCTGCCCCC | no data |
| SEQ ID 1888 | COMP ID 1888 | CTGGGGGCAGCAGTGCTG | 1457 | 1474 | 6951 | 6968 | SEQ ID 3516 | CAGCACTGCTGCCCCCAG | 2.15 |
| SEQ ID 1889 | COMP ID 1889 | CCCTGGGGGCAGCAGTGC | 1459 | 1476 | 6953 | 6970 | SEQ ID 3517 | GCACTGCTGCCCCCAGGG | 1.71 |
| SEQ ID 1890 | COMP ID 1890 | AGCCCTGGGGGCAGCAGT | 1461 | 1478 | 6955 | 6972 | SEQ ID 3518 | ACTGCTGCCCCCAGGGCT | 1.36 |
| SEQ ID 1891 | COMP ID 1891 | GTAGCCCTGGGGGCAGCA | 1463 | 1480 | 6957 | 6974 | SEQ ID 3519 | TGCTGCCCCCAGGGCTAC | no data |
| SEQ ID 1892 | COMP ID 1892 | GTGTAGCCCTGGGGGCAG | 1465 | 1482 | 6959 | 6976 | SEQ ID 3520 | CTGCCCCCAGGGCTACAC | no data |
| SEQ ID 1893 | COMP ID 1893 | ACGTGTAGCCCTGGGGGC | 1467 | 1484 | 6961 | 6978 | SEQ ID 3521 | GCCCCCAGGGCTACACGT | 2.09 |
| SEQ ID 1894 | COMP ID 1894 | ACACGTGTAGCCCTGGGG | 1469 | 1486 | 6963 | 6980 | SEQ ID 3522 | CCCCAGGGCTACACGTGT | 1.58 |
| SEQ ID 1895 | COMP ID 1895 | ACACACGTGTAGCCCTGG | 1471 | 1488 | 6965 | 6982 | SEQ ID 3523 | CCAGGGCTACACGTGTGT | 1.42 |
| SEQ ID 1896 | COMP ID 1896 | CTACACACGTGTAGCCCT | 1473 | 1490 | 6967 | 6984 | SEQ ID 3524 | AGGGCTACACGTGTGTAG | 1.39 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) Position End | Target Site Sequence ID | Target Site Sequence | Relative Progranulin expression (Relative to PBS) |
|---|---|---|---|---|---|---|---|---|---|
| SEQ ID 1897 | COMP ID 1897 | AGCTACACACGTGTAGCC | 1475 | 1492 | 6969 | 6986 | SEQ ID 3525 | GGCTACACGTGTGTAGCT | 1.23 |
| SEQ ID 1898 | COMP ID 1898 | TCAGCTACACACGTGTAG | 1477 | 1494 | 6971 | 6988 | SEQ ID 3526 | CTACACGTGTGTAGCTGA | 1.21 |
| SEQ ID 1899 | COMP ID 1899 | CCTCAGCTACACACGTGT | 1479 | 1496 | 6973 | 6990 | SEQ ID 3527 | ACACGTGTGTAGCTGAGG | 1.41 |
| SEQ ID 1900 | COMP ID 1900 | CCCCTCAGCTACACACGT | 1481 | 1498 | 6975 | 6992 | SEQ ID 3528 | ACGTGTGTAGCTGAGGGG | 1.17 |
| SEQ ID 1901 | COMP ID 1901 | TGCCCCTCAGCTACACAC | 1483 | 1500 | 6977 | 6994 | SEQ ID 3529 | GTGTGTAGCTGAGGGGCA | 0.85 |
| SEQ ID 1902 | COMP ID 1902 | ACTGCCCCTCAGCTACAC | 1485 | 1502 | 6979 | 6996 | SEQ ID 3530 | GTGTAGCTGAGGGGCAGT | 1.3 |
| SEQ ID 1903 | COMP ID 1903 | ACACTGCCCCTCAGCTAC | 1487 | 1504 | 6981 | 6998 | SEQ ID 3531 | GTAGCTGAGGGGCAGTGT | 1.13 |
| SEQ ID 1904 | COMP ID 1904 | TGACACTGCCCCTCAGCT | 1489 | 1506 | 6983 | 7000 | SEQ ID 3532 | AGCTGAGGGGCAGTGTCA | 1.25 |
| SEQ ID 1905 | COMP ID 1905 | GCTGACACTGCCCCTCAG | 1491 | 1508 | 6985 | 7002 | SEQ ID 3533 | CTGAGGGGCAGTGTCAGC | no data |
| SEQ ID 1906 | COMP ID 1906 | TCGCTGACACTGCCCCTC | 1493 | 1510 | 6987 | 7004 | SEQ ID 3534 | GAGGGGCAGTGTCAGCGA | 1.09 |
| SEQ ID 1907 | COMP ID 1907 | CCTCGCTGACACTGCCCC | 1495 | 1512 | 6989 | 7006 | SEQ ID 3535 | GGGGCAGTGTCAGCGAGG | 1.18 |
| SEQ ID 1908 | COMP ID 1908 | TTCCTCGCTGACACTGCC | 1497 | 1514 | 6991 | 7008 | SEQ ID 3536 | GGCAGTGTCAGCGAGGAA | 1.2 |
| SEQ ID 1909 | COMP ID 1909 | GCTTCCTCGCTGACACTG | 1499 | 1516 | 6993 | 7010 | SEQ ID 3537 | CAGTGTCAGCGAGGAAGC | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1910 | COMP ID 1910 | TCGCTTCCTCGCTGACAC | 1501 | 1518 | 6995 | 7012 | SEQ ID 3538 | GTGTCAGCGAGGAAGCGA | 1.41 |
| SEQ ID 1911 | COMP ID 1911 | TCTCGCTTCCTCGCTGAC | 1503 | 1520 | 6997 | 7014 | SEQ ID 3539 | GTCAGCGAGGAAGCGAGA | 1.26 |
| SEQ ID 1912 | COMP ID 1912 | GATCTCGCTTCCTCGCTG | 1505 | 1522 | 6999 | 7016 | SEQ ID 3540 | CAGCGAGGAAGCGAGATC | no data |
| SEQ ID 1913 | COMP ID 1913 | ACGATCTCGCTTCCTCGC | 1507 | 1524 | 7001 | 7018 | SEQ ID 3541 | GCGAGGAAGCGAGATCGT | 1.25 |
| SEQ ID 1914 | COMP ID 1914 | CCACGATCTCGCTTCCTC | 1509 | 1526 | 7003 | 7020 | SEQ ID 3542 | GAGGAAGCGAGATCGTGG | 1.25 |
| SEQ ID 1915 | COMP ID 1915 | AGCCACGATCTCGCTTCC | 1511 | 1528 | 7005 | 7022 | SEQ ID 3543 | GGAAGCGAGATCGTGGCT | 1.31 |
| SEQ ID 1916 | COMP ID 1916 | CCAGCCACGATCTCGCTT | 1513 | 1530 | 7007 | 7024 | SEQ ID 3544 | AAGCGAGATCGTGGCTGG | 1.4 |
| SEQ ID 1917 | COMP ID 1917 | GTCCAGCCACGATCTCGC | 1515 | 1532 | 7009 | 7026 | SEQ ID 3545 | GCGAGATCGTGGCTGGAC | no data |
| SEQ ID 1918 | COMP ID 1918 | CAGTCCAGCCACGATCTC | 1517 | 1534 | 7011 | 7028 | SEQ ID 3546 | GAGATCGTGGCTGGACTG | 1.26 |
| SEQ ID 1919 | COMP ID 1919 | TCCAGTCCAGCCACGATC | 1519 | 1536 | 7013 | 7030 | SEQ ID 3547 | GATCGTGGCTGGACTGGA | 0.95 |
| SEQ ID 1920 | COMP ID 1920 | TCTCCAGTCCAGCCACGA | 1521 | 1538 | 7015 | 7032 | SEQ ID 3548 | TCGTGGCTGGACTGGAGA | 1.1 |
| SEQ ID 1921 | COMP ID 1921 | CTTCTCCAGTCCAGCCAC | 1523 | 1540 | 7017 | 7034 | SEQ ID 3549 | GTGCTGGACTGGAGAAG | 1.3 |
| SEQ ID 1922 | COMP ID 1922 | ATCTTCTCCAGTCCAGCC | 1525 | 1542 | 7019 | 7036 | SEQ ID 3550 | GGCTGGACTGGAGAAGAT | 1.14 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1923 | COMP ID 1923 | GCATCTTCTCCAGTCCAG | 1527 | 1544 | 7021 | 7038 | SEQ ID 3551 | CTGGACTGGAGAAGATGC | no data |
| SEQ ID 1924 | COMP ID 1924 | AGGCATCTTCTCCAGTCC | 1529 | 1546 | 7023 | 7040 | SEQ ID 3552 | GGACTGGAGAAGATGCCT | 1.34 |
| SEQ ID 1925 | COMP ID 1925 | GCAGGCATCTTCTCCAGT | 1531 | 1548 | 7025 | 7042 | SEQ ID 3553 | ACTGGAGAAGATGCCTGC | no data |
| SEQ ID 1926 | COMP ID 1926 | GGGCAGGCATCTTCTCCA | 1533 | 1550 | 7027 | 7044 | SEQ ID 3554 | TGGAGAAGATGCCTGCCC | no data |
| SEQ ID 1927 | COMP ID 1927 | GCGGGCAGGCATCTTCTC | 1535 | 1552 | 7029 | 7046 | SEQ ID 3555 | GAGAAGATGCCTGCCCGC | no data |
| SEQ ID 1928 | COMP ID 1928 | CGGCGGGCAGGCATCTTC | 1537 | 1554 | 7031 | 7048 | SEQ ID 3556 | GAAGATGCCTGCCCGCCG | 1.75 |
| SEQ ID 1929 | COMP ID 1929 | CCCGGCGGGCAGGCATCT | 1539 | 1556 | 7033 | 7050 | SEQ ID 3557 | AGATGCCTGCCCGCCGGG | 1.51 |
| SEQ ID 1930 | COMP ID 1930 | AGCCCGGCGGGCAGGCAT | 1541 | 1558 | 7035 | 7052 | SEQ ID 3558 | ATGCCTGCCCGCCGGGCT | 1.34 |
| SEQ ID 1931 | COMP ID 1931 | GAAGCCCGGCGGGCAGGC | 1543 | 1560 | 7037 | 7054 | SEQ ID 3559 | GCCTGCCCGCCGGGCTTC | no data |
| SEQ ID 1932 | COMP ID 1932 | AGGAAGCCCGGCGGGCAG | 1545 | 1562 | 7039 | 7056 | SEQ ID 3560 | CTGCCCGCCGGGCTTCCT | 1.48 |
| SEQ ID 1933 | COMP ID 1933 | TAAGGAAGCCCGGCGGGC | 1547 | 1564 | 7041 | 7058 | SEQ ID 3561 | GCCCGCCGGGCTTCCTTA | 1.54 |
| SEQ ID 1934 | COMP ID 1934 | GATAAGGAAGCCCGGCGG | 1549 | 1566 | 7043 | 7060 | SEQ ID 3562 | CCGCCGGGCTTCCTTATC | no data |
| SEQ ID 1935 | COMP ID 1935 | GGGATAAGGAAGCCCGGC | 1551 | 1568 | 7045 | 7062 | SEQ ID 3563 | GCCGGGCTTCCTTATCCC | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1936 | COMP ID 1936 | GTGGGATAAGGAAGCCCG | 1553 | 1570 | 7047 | 7064 | SEQ ID 3564 | CGGGCTTCCTTATCCCAC | no data |
| SEQ ID 1937 | COMP ID 1937 | GGGTGGGATAAGGAAGCC | 1555 | 1572 | 7049 | 7066 | SEQ ID 3565 | GGCTTCCTTATCCCACCC | no data |
| SEQ ID 1938 | COMP ID 1938 | TGGGGTGGGATAAGGAAG | 1557 | 1574 | 7051 | 7068 | SEQ ID 3566 | CTTCCTTATCCCACCCCA | 2.09 |
| SEQ ID 1939 | COMP ID 1939 | TCTGGGGTGGGATAAGGA | 1559 | 1576 | 7053 | 7070 | SEQ ID 3567 | TCCTTATCCCACCCCAGA | 2.2 |
| SEQ ID 1940 | COMP ID 1940 | TCTCTGGGGTGGGATAAG | 1561 | 1578 | 7055 | 7072 | SEQ ID 3568 | CTTATCCCACCCCAGAGA | 2.51 |
| SEQ ID 1941 | COMP ID 1941 | TGTCTCTGGGGTGGGATA | 1563 | 1580 | 7057 | 7074 | SEQ ID 3569 | TATCCCACCCCAGAGACA | 2.49 |
| SEQ ID 1942 | COMP ID 1942 | GATGTCTCTGGGGTGGGA | 1565 | 1582 | 7059 | 7076 | SEQ ID 3570 | TCCCACCCCAGAGACATC | no data |
| SEQ ID 1943 | COMP ID 1943 | CCGATGTCTCTGGGGTGG | 1567 | 1584 | 7061 | 7078 | SEQ ID 3571 | CCACCCCAGAGACATCGG | 2.04 |
| SEQ ID 1944 | COMP ID 1944 | AGCCGATGTCTCTGGGGT | 1569 | 1586 | 7063 | 7080 | SEQ ID 3572 | ACCCCAGAGACATCGGCT | 1.96 |
| SEQ ID 1945 | COMP ID 1945 | ACAGCCGATGTCTCTGGG | 1571 | 1588 | 7065 | 7082 | SEQ ID 3573 | CCCAGAGACATCGGCTGT | 1.45 |
| SEQ ID 1946 | COMP ID 1946 | TCACAGCCGATGTCTCTG | 1573 | 1590 | 7067 | 7084 | SEQ ID 3574 | CAGAGACATCGGCTGTGA | 1.39 |
| SEQ ID 1947 | COMP ID 1947 | GGTCACAGCCGATGTCTC | 1575 | 1592 | 7069 | 7086 | SEQ ID 3575 | GAGACATCGGCTGTGACC | no data |
| SEQ ID 1948 | COMP ID 1948 | CTGGTCACAGCCGATGTC | 1577 | 1594 | 7071 | 7088 | SEQ ID 3576 | GACATCGGCTGTGACCAG | 1.68 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1949 | COMP ID 1949 | TGCTGGTCACAGCCGATG | 1579 | 1596 | 7073 | 7090 | SEQ ID 3577 | CATCGGCTGTGACCAGCA | 1.41 |
| SEQ ID 1950 | COMP ID 1950 | TGTGCTGGTCACAGCCGA | 1581 | 1598 | 7075 | 7092 | SEQ ID 3578 | TCGGCTGTGACCAGCACA | 1.66 |
| SEQ ID 1951 | COMP ID 1951 | GGTGTGCTGGTCACAGCC | 1583 | 1600 | 7077 | 7094 | SEQ ID 3579 | GGCTGTGACCAGCACACC | no data |
| SEQ ID 1952 | COMP ID 1952 | CTGGTGTGCTGGTCACAG | 1585 | 1602 | 7079 | 7096 | SEQ ID 3580 | CTGTGACCAGCACACCAG | 1.66 |
| SEQ ID 1953 | COMP ID 1953 | AGCTGGTGTGCTGGTCAC | 1587 | 1604 | 7081 | 7098 | SEQ ID 3581 | GTGACCAGCACACCAGCT | 1.23 |
| SEQ ID 1954 | COMP ID 1954 | GCAGCTGGTGTGCTGGTC | 1589 | 1606 | 7083 | 7100 | SEQ ID 3582 | GACCAGCACACCAGCTGC | no data |
| SEQ ID 1955 | COMP ID 1955 | GGGCAGCTGGTGTGCTGG | 1591 | 1608 | 7085 | 7102 | SEQ ID 3583 | CCAGCACACCAGCTGCCC | no data |
| SEQ ID 1956 | COMP ID 1956 | CCGGGCAGCTGGTGTGCT | 1593 | 1610 | 7087 | 7104 | SEQ ID 3584 | AGCACACCAGCTGCCCGG | 1.54 |
| SEQ ID 1957 | COMP ID 1957 | CACCGGGCAGCTGGTGTG | 1595 | 1612 | 7089 | 7106 | SEQ ID 3585 | CACACCAGCTGCCCGGTG | 1.26 |
| SEQ ID 1958 | COMP ID 1958 | CCCACCGGGCAGCTGGTG | 1597 | 1614 | 7091 | 7108 | SEQ ID 3586 | CACCAGCTGCCCGGTGGG | 1.28 |
| SEQ ID 1959 | COMP ID 1959 | GCCCCACCGGGCAGCTGG | 1599 | 1616 | 7093 | 7110 | SEQ ID 3587 | CCAGCTGCCCGGTGGGGC | no data |
| SEQ ID 1960 | COMP ID 1960 | CTGCCCCACCGGGCAGCT | 1601 | 1618 | 7095 | 7112 | SEQ ID 3588 | AGCTGCCCGGTGGGGCAG | 1.46 |
| SEQ ID 1961 | COMP ID 1961 | GTCTGCCCCACCGGGCAG | 1603 | 1620 | 7097 | 7114 | SEQ ID 3589 | CTGCCCGGTGGGGCAGAC | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1962 | COMP ID 1962 | AGGTCTGCCCACCGGGC | 1605 | 1622 | 7099 | 7116 | SEQ ID 3590 | GCCCGGTGGGCAGACCT | 1.21 |
| SEQ ID 1963 | COMP ID 1963 | GCAGGTCTGCCCCACCGG | 1607 | 1624 | 7101 | 7118 | SEQ ID 3591 | CCGGTGGGCAGACCTGC | no data |
| SEQ ID 1964 | COMP ID 1964 | CAGCAGGTCTGCCCCACC | 1609 | 1626 | 7103 | 7120 | SEQ ID 3592 | GGTGGGCAGACCTGCTG | 1.33 |
| SEQ ID 1965 | COMP ID 1965 | GGCAGCAGGTCTGCCCCA | 1611 | 1628 | 7105 | 7122 | SEQ ID 3593 | TGGGCAGACCTGCTGCC | no data |
| SEQ ID 1966 | COMP ID 1966 | CGGGCAGCAGGTCTGCCC | 1613 | 1630 | 7107 | 7124 | SEQ ID 3594 | GGGCAGACCTGCTGCCCG | 1.52 |
| SEQ ID 1967 | COMP ID 1967 | CTCGGGCAGCAGGTCTGC | 1615 | 1632 | 7109 | 7126 | SEQ ID 3595 | GCAGACCTGCTGCCCGAG | 1.2 |
| SEQ ID 1968 | COMP ID 1968 | GGCTCGGGCAGCAGGTCT | 1617 | 1634 | 7111 | 7128 | SEQ ID 3596 | AGACCTGCTGCCCGAGCC | no data |
| SEQ ID 1969 | COMP ID 1969 | CAGGCTCGGGCAGCAGGT | 1619 | 1636 | 7113 | 7130 | SEQ ID 3597 | ACCTGCTGCCCGAGCCTG | no data |
| SEQ ID 1970 | COMP ID 1970 | CCCAGGCTCGGGCAGCAG | 1621 | 1638 | 7115 | 7132 | SEQ ID 3598 | CTGCTGCCCGAGCCTGGG | 1.2 |
| SEQ ID 1971 | COMP ID 1971 | CACCCAGGCTCGGGCAGC | 1623 | 1640 | 7117 | 7134 | SEQ ID 3599 | GCTGCCCGAGCCTGGGTG | 1.41 |
| SEQ ID 1972 | COMP ID 1972 | CCCACCCAGGCTCGGGCA | 1625 | 1642 | 7119 | 7136 | SEQ ID 3600 | TGCCCGAGCCTGGGTGGG | 1.24 |
| SEQ ID 1973 | COMP ID 1973 | CTCCCACCCAGGCTCGGG | 1627 | 1644 | 7121 | 7138 | SEQ ID 3601 | CCCGAGCCTGGGTGGGAG | 1.06 |
| SEQ ID 1974 | COMP ID 1974 | AGTCCCACCCAGGCTCG | 1629 | 1646 | 7123 | 7140 | SEQ ID 3602 | CGAGCCTGGGTGGGAGCT | 1.24 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every $2^{nd}$ or $3^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1975 | COMP ID 1975 | CCAGCTCCCACCCAGGCT | 1631 | 1648 | 7125 | 7142 | SEQ ID 3603 | AGCCTGGGTGGGAGCTGG | 1.1 |
| SEQ ID 1976 | COMP ID 1976 | GCCCAGCTCCCACCCAGG | 1633 | 1650 | 7127 | 7144 | SEQ ID 3604 | CCTGGGTGGGAGCTGGGC | no data |
| SEQ ID 1977 | COMP ID 1977 | AGGCCCAGCTCCCACCCA | 1635 | 1652 | 7129 | 7146 | SEQ ID 3605 | TGGGTGGGAGCTGGGCCT | 1.08 |
| SEQ ID 1978 | COMP ID 1978 | GCAGGCCCAGCTCCCACC | 1637 | 1654 | 7131 | 7148 | SEQ ID 3606 | GGTGGGAGCTGGGCCTGC | no data |
| SEQ ID 1979 | COMP ID 1979 | CAGCAGGCCCAGCTCCCA | 1639 | 1656 | 7133 | 7150 | SEQ ID 3607 | TGGAGCTGGGCCTGCTG | 1.24 |
| SEQ ID 1980 | COMP ID 1980 | GGCAGCAGGCCCAGCTCC | 1641 | 1658 | 7135 | 7152 | SEQ ID 3608 | GGAGCTGGGCCTGCTGCC | no data |
| SEQ ID 1981 | COMP ID 1981 | CTGGCAGCAGGCCCAGCT | 1643 | 1660 | 7137 | 7154 | SEQ ID 3609 | AGCTGGGCCTGCTGCCAG | 1.49 |
| SEQ ID 1982 | COMP ID 1982 | AACTGGCAGCAGGCCCAG | 1645 | 1662 | 7139 | 7156 | SEQ ID 3610 | CTGGCCTGCTGCCAGTT | 1.25 |
| SEQ ID 1983 | COMP ID 1983 | GCAACTGGCAGCAGGCCC | 1647 | 1664 | 7141 | 7158 | SEQ ID 3611 | GGGCCTGCTGCCAGTTGC | no data |
| SEQ ID 1984 | COMP ID 1984 | GGGCAACTGGCAGCAGGC | 1649 | 1666 | 7143 | 7160 | SEQ ID 3612 | GCCTGCTGCCAGTTGCCC | no data |
| SEQ ID 1985 | COMP ID 1985 | TGGGGCAACTGGCAGCAG | 1651 | 1668 | 7145 | 7162 | SEQ ID 3613 | CTGCTGCCAGTTGCCCCA | 2.46 |
| SEQ ID 1986 | COMP ID 1986 | CATGGGGCAACTGGCAGC | 1653 | 1670 | 7147 | 7164 | SEQ ID 3614 | GCTGCCAGTTGCCCCATG | 2.39 |
| SEQ ID 1987 | COMP ID 1987 | CACATGGGGCAACTGGCA | | | 7149 | 7166 | SEQ ID 3615 | TGCCAGTTGCCCCATGTG | 1.23 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 1988 | COMP ID 1988 | CTCACATGGGCAACTGG | | | 7151 | 7168 | SEQ ID 3616 | CCAGTTGCCCATGTGAG | 1.23 |
| SEQ ID 1989 | COMP ID 1989 | CACTCACATGGGCAACT | | | 7153 | 7170 | SEQ ID 3617 | AGTTGCCCATGTGAGTG | 1.03 |
| SEQ ID 1990 | COMP ID 1990 | GGCACTCACATGGGCAA | | | 7155 | 7172 | SEQ ID 3618 | TTGCCCCATGTGAGTGCC | no data |
| SEQ ID 1991 | COMP ID 1991 | GAGGCACTCACATGGGC | | | 7157 | 7174 | SEQ ID 3619 | GCCCATGTGAGTGCCTC | no data |
| SEQ ID 1992 | COMP ID 1992 | GGGAGGCACTCACATGG | | | 7159 | 7176 | SEQ ID 3620 | CCCATGTGAGTGCCTCCC | no data |
| SEQ ID 1993 | COMP ID 1993 | CAGGGAGGCACTCACATG | | | 7161 | 7178 | SEQ ID 3621 | CATGTGAGTGCCTCCCTG | 1.3 |
| SEQ ID 1994 | COMP ID 1994 | GGCAGGGAGGCACTCACA | | | 7163 | 7180 | SEQ ID 3622 | TGTGAGTGCCTCCCTGCC | no data |
| SEQ ID 1995 | COMP ID 1995 | CAGCAGGGAGGCACTCA | | | 7165 | 7182 | SEQ ID 3623 | TGAGTGCCTCCCTGCCTG | 1.14 |
| SEQ ID 1996 | COMP ID 1996 | GGCAGCAGGGAGGCACT | | | 7167 | 7184 | SEQ ID 3624 | AGTGCCTCCCTGCCTGCC | 2.25 |
| SEQ ID 1997 | COMP ID 1997 | GGGGCAGCAGGGAGGCA | | | 7169 | 7186 | SEQ ID 3625 | TGCCTCCCTGCCTGCCCC | 2.22 |
| SEQ ID 1998 | COMP ID 1998 | CAGGGGCAGCAGGGAGG | | | 7171 | 7188 | SEQ ID 3626 | CCTCCCTGCCTGCCCCTG | 1.69 |
| SEQ ID 1999 | COMP ID 1999 | TCCAGGGGCAGCAGGGA | | | 7173 | 7190 | SEQ ID 3627 | TCCCTGCCTGCCCCTGGA | 2.17 |
| SEQ ID 2000 | COMP ID 2000 | TATCCAGGGGCAGCAGG | | | 7175 | 7192 | SEQ ID 3628 | CCTGCCTGCCCCTGGATA | 1.76 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 2001 | COMP ID 2001 | CCTATCCAGGGGCAGGCA | | | 7177 | 7194 | SEQ ID 3629 | TGCCTGCCCTGGATAGG | 1.3 |
| SEQ ID 2002 | COMP ID 2002 | CCCCTATCCAGGGCAGG | | | 7179 | 7196 | SEQ ID 3630 | CCTGCCCCTGGATAGGGG | 1.02 |
| SEQ ID 2003 | COMP ID 2003 | CTCCCCTATCCAGGGGCA | | | 7181 | 7198 | SEQ ID 3631 | TGCCCCTGGATAGGGGAG | 1.16 |
| SEQ ID 2004 | COMP ID 2004 | AGCTCCCCTATCCAGGGG | | | 7183 | 7200 | SEQ ID 3632 | CCCCTGGATAGGGGAGCT | 1.39 |
| SEQ ID 2005 | COMP ID 2005 | TTAGCTCCCCTATCCAGG | | | 7185 | 7202 | SEQ ID 3633 | CCTGGATAGGGGAGCTAA | 1.54 |
| SEQ ID 2006 | COMP ID 2006 | GCTTAGCTCCCCTATCCA | | | 7187 | 7204 | SEQ ID 3634 | TGGATAGGGGAGCTAAGC | no data |
| SEQ ID 2007 | COMP ID 2007 | GGGCTTAGCTCCCCTATC | | | 7189 | 7206 | SEQ ID 3635 | GATAGGGGAGCTAAGCCC | no data |
| SEQ ID 2008 | COMP ID 2008 | CTGGGCTTAGCTCCCCTA | | | 7191 | 7208 | SEQ ID 3636 | TAGGGGAGCTAAGCCCAG | 1.31 |
| SEQ ID 2009 | COMP ID 2009 | CACTGGGCTTAGCTCCCC | | | 7193 | 7210 | SEQ ID 3637 | GGGGAGCTAAGCCCAGTG | 1.15 |
| SEQ ID 2010 | COMP ID 2010 | CTCACTGGGCTTAGCTCC | | | 7195 | 7212 | SEQ ID 3638 | GGAGCTAAGCCCAGTGAG | 1.15 |
| SEQ ID 2011 | COMP ID 2011 | CCCTCACTGGGCTTAGCT | | | 7197 | 7214 | SEQ ID 3639 | AGCTAAGCCCAGTGAGGG | 1.25 |
| SEQ ID 2012 | COMP ID 2012 | GTTCCTGTCCCCTCACTG | | | 7206 | 7223 | SEQ ID 3640 | CAGTGAGGGACAGGAAC | no data |
| SEQ ID 2013 | COMP ID 2013 | ATGTTCCTGTCCCCTCAC | | | 7208 | 7225 | SEQ ID 3641 | GTGAGGGGACAGGAACAT | 1.51 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 2014 | COMP ID 2014 | TTATGTTCCTGTCCCCTC | | | 7210 | 7227 | SEQ ID 3642 | GAGGGACAGGAACATAA | 1.44 |
| SEQ ID 2015 | COMP ID 2015 | CATTATGTTCCTGTCCCC | | | 7212 | 7229 | SEQ ID 3643 | GGGGACAGGAACATAATG | 1.61 |
| SEQ ID 2016 | COMP ID 2016 | GGCATTATGTTCCTGTCC | | | 7214 | 7231 | SEQ ID 3644 | GGACAGGAACATAATGCC | no data |
| SEQ ID 2017 | COMP ID 2017 | ATGGCATTATGTTCCTGT | | | 7216 | 7233 | SEQ ID 3645 | ACAGGAACATAATGCCAT | 1.28 |
| SEQ ID 2018 | COMP ID 2018 | GAATGGCATTATGTTCCT | | | 7218 | 7235 | SEQ ID 3646 | AGGAACATAATGCCATTC | no data |
| SEQ ID 2019 | COMP ID 2019 | CAGAATGGCATTATGTTC | | | 7220 | 7237 | SEQ ID 3647 | GAACATAATGCCATTCTG | 1.34 |
| SEQ ID 2020 | COMP ID 2020 | CACAGAATGGCATTATGT | | | 7222 | 7239 | SEQ ID 3648 | ACATAATGCCATTCTGTG | 1.51 |
| SEQ ID 2021 | COMP ID 2021 | AGCACAGAATGGCATTAT | | | 7224 | 7241 | SEQ ID 3649 | ATAATGCCATTCTGTGCT | 1.46 |
| SEQ ID 2022 | COMP ID 2022 | GGAGCACAGAATGGCATT | | | 7226 | 7243 | SEQ ID 3650 | AATGCCATTCTGTGCTCC | no data |
| SEQ ID 2023 | COMP ID 2023 | AGGGAGCACAGAATGGCA | | | 7228 | 7245 | SEQ ID 3651 | TGCCATTCTGTGCTCCCT | 1.88 |
| SEQ ID 2024 | COMP ID 2024 | GAAGGGAGCACAGAATGG | | | 7230 | 7247 | SEQ ID 3652 | CCATTCTGTGCTCCCTTC | no data |
| SEQ ID 2025 | COMP ID 2025 | GGGAAGGGAGCACAGAAT | | | 7232 | 7249 | SEQ ID 3653 | ATTCTGTGCTCCCTTCCC | no data |
| SEQ ID 2026 | COMP ID 2026 | CGGGGAAGGGAGCACAGA | | | 7234 | 7251 | SEQ ID 3654 | TCTGTGCTCCCTTCCCCG | 2.53 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 2027 | COMP ID 2027 | GGCGGGGAAGGGAGCACA | | | 7236 | 7253 | SEQ ID 3655 | TGTGCTCCCTTCCCCGCC | no data |
| SEQ ID 2028 | COMP ID 2028 | CTGGCGGGAAGGGAGCA | | | 7238 | 7255 | SEQ ID 3656 | TGCTCCCTTCCCCGCCAG | 2.66 |
| SEQ ID 2029 | COMP ID 2029 | GCCTGGCGGGGAAGGGAG | | | 7240 | 7257 | SEQ ID 3657 | CTCCCTTCCCCGCCAGGC | no data |
| SEQ ID 2030 | COMP ID 2030 | CAGCCTGGGGGGAAGGG | | | 7242 | 7259 | SEQ ID 3658 | CCCTTCCCCGCCAGGCTG | no data |
| SEQ ID 2031 | COMP ID 2031 | CACAGCCTGGCGGGGAAG | | | 7244 | 7261 | SEQ ID 3659 | CTTCCCCGCCAGGCTGTG | 2.31 |
| SEQ ID 2032 | COMP ID 2032 | CACACAGCCTGGCGGGGA | | | 7246 | 7263 | SEQ ID 3660 | TCCCCGCCAGGCTGTGTG | 1.88 |
| SEQ ID 2033 | COMP ID 2033 | AGCACACAGCCTGGCGGG | | | 7248 | 7265 | SEQ ID 3661 | CCCGCCAGGCTGTGTGCT | 2 |
| SEQ ID 2034 | COMP ID 2034 | GCAGCACACAGCCTGGCG | | | 7250 | 7267 | SEQ ID 3662 | CGCCAGGCTGTGTGCTGC | no data |
| SEQ ID 2035 | COMP ID 2035 | TCGCAGCACACAGCCTGG | | | 7252 | 7269 | SEQ ID 3663 | CCAGGCTGTGTGCTGCGA | 1.26 |
| SEQ ID 2036 | COMP ID 2036 | CCTCGCAGCACACAGCCT | | | 7254 | 7271 | SEQ ID 3664 | AGGCTGTGTGCTGCGAGG | 1.35 |
| SEQ ID 2037 | COMP ID 2037 | ATCCTCGCAGCACACAGC | 1670 | 1687 | 7256 | 7273 | SEQ ID 3665 | GCTGTGTGCTGCGAGGAT | 1.4 |
| SEQ ID 2038 | COMP ID 2038 | CGATCCTCGCAGCACACA | 1672 | 1689 | 7258 | 7275 | SEQ ID 3666 | TGTGTGCTGCGAGGATCG | 1.21 |
| SEQ ID 2039 | COMP ID 2039 | GGCGATCCTCGCAGCACA | 1674 | 1691 | 7260 | 7277 | SEQ ID 3667 | TGTGCTGCGAGGATCGCC | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 2040 | COMP ID 2040 | CTGCGATCCTCGCAGCA | 1676 | 1693 | 7262 | 7279 | SEQ ID 3668 | TGCTGCGAGGATCGCCAG | no data |
| SEQ ID 2041 | COMP ID 2041 | TGCTGGCGATCCTCGCAG | 1678 | 1695 | 7264 | 7281 | SEQ ID 3669 | CTGCGGAGGATCGCCAGCA | 0.52 |
| SEQ ID 2042 | COMP ID 2042 | AGTGCTGGCGATCCTCGC | 1680 | 1697 | 7266 | 7283 | SEQ ID 3670 | GCGAGGATCGCCAGCACT | 1.75 |
| SEQ ID 2043 | COMP ID 2043 | GCAGTGCTGGCGATCCTC | 1682 | 1699 | 7268 | 7285 | SEQ ID 3671 | GAGGATCGCCAGCACTGC | no data |
| SEQ ID 2044 | COMP ID 2044 | CAGCAGTGCTGGCGATCC | 1684 | 1701 | 7270 | 7287 | SEQ ID 3672 | GGATCGCCAGCACTGCTG | 1.45 |
| SEQ ID 2045 | COMP ID 2045 | GGCAGCAGTGCTGGCGAT | 1686 | 1703 | 7272 | 7289 | SEQ ID 3673 | ATCGCCAGCACTGCTGCC | no data |
| SEQ ID 2046 | COMP ID 2046 | CGGGCAGCAGTGCTGGCG | 1688 | 1705 | 7274 | 7291 | SEQ ID 3674 | CGCCAGCACTGCTGCCCG | 0.55 |
| SEQ ID 2047 | COMP ID 2047 | GCCGGGCAGCAGTGCTGG | 1690 | 1707 | 7276 | 7293 | SEQ ID 3675 | CCAGCACTGCTGCCCGGC | no data |
| SEQ ID 2048 | COMP ID 2048 | CAGCCGGGCAGCAGTGCT | 1692 | 1709 | 7278 | 7295 | SEQ ID 3676 | AGCACTGCTGCCCGGCTG | 1.76 |
| SEQ ID 2049 | COMP ID 2049 | GCCAGCCGGGCAGCAGTG | 1694 | 1711 | 7280 | 7297 | SEQ ID 3677 | CACTGCTGCCCGGCTGGC | no data |
| SEQ ID 2050 | COMP ID 2050 | TAGCCAGCCGGGCAGCAG | 1696 | 1713 | 7282 | 7299 | SEQ ID 3678 | CTGCTGCCCGGCTGGCTA | 1.31 |
| SEQ ID 2051 | COMP ID 2051 | TGTAGCCAGCCGGGCAGC | 1698 | 1715 | 7284 | 7301 | SEQ ID 3679 | GCTGCCCGGCTGGCTACA | 1.35 |
| SEQ ID 2052 | COMP ID 2052 | GGTGTAGCCAGCCGGGCA | 1700 | 1717 | 7286 | 7303 | SEQ ID 3680 | TGCCCGGCTGGCTACACC | 1.71 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 2053 | COMP ID 2053 | CAGGTGTAGCCAGCCGGG | 1702 | 1719 | 7288 | 7305 | SEQ ID 3681 | CCCGCTGGCTACACCTG | 1.56 |
| SEQ ID 2054 | COMP ID 2054 | TGCAGGTGTAGCCAGCCG | 1704 | 1721 | 7290 | 7307 | SEQ ID 3682 | CGGCTGGCTACACCTGCA | 1.43 |
| SEQ ID 2055 | COMP ID 2055 | GTTGCAGGTGTAGCCAGC | 1706 | 1723 | 7292 | 7309 | SEQ ID 3683 | GCTGGCTACACCTGCAAC | 1.76 |
| SEQ ID 2056 | COMP ID 2056 | ACGTTGCAGGTGTAGCCA | 1708 | 1725 | 7294 | 7311 | SEQ ID 3684 | TGGCTACACCTGCAACGT | 1.5 |
| SEQ ID 2057 | COMP ID 2057 | TCACGTTGCAGGTGTAGC | 1710 | 1727 | 7296 | 7313 | SEQ ID 3685 | GCTACACCTGCAACGTGA | 1.54 |
| SEQ ID 2058 | COMP ID 2058 | CTTCACGTTGCAGGTGTA | 1712 | 1729 | 7298 | 7315 | SEQ ID 3686 | TACACCTGCAACGTGAAG | 1.75 |
| SEQ ID 2059 | COMP ID 2059 | GCCTTCACGTTGCAGGTG | 1714 | 1731 | 7300 | 7317 | SEQ ID 3687 | CACCTGCAACGTGAAGGC | 1.76 |
| SEQ ID 2060 | COMP ID 2060 | GAGCCTTCACGTTGCAGG | 1716 | 1733 | 7302 | 7319 | SEQ ID 3688 | CCTGCAACGTGAAGGCTC | 1.72 |
| SEQ ID 2061 | COMP ID 2061 | TCGAGCCTTCACGTTGCA | 1718 | 1735 | 7304 | 7321 | SEQ ID 3689 | TGCAACGTGAAGGCTCGA | 2.03 |
| SEQ ID 2062 | COMP ID 2062 | GATCGAGCCTTCACGTTG | 1720 | 1737 | 7306 | 7323 | SEQ ID 3690 | CAACGTGAAGGCTCGATC | 1.41 |
| SEQ ID 2063 | COMP ID 2063 | AGGATCGAGCCTTCACGT | 1722 | 1739 | 7308 | 7325 | SEQ ID 3691 | ACGTGAAGGCTCGATCCT | 1.77 |
| SEQ ID 2064 | COMP ID 2064 | GCAGGATCGAGCCTTCAC | 1724 | 1741 | 7310 | 7327 | SEQ ID 3692 | GTGAAGGCTCGATCCTGC | 1.37 |
| SEQ ID 2065 | COMP ID 2065 | TCGCAGGATCGAGCCTTC | 1726 | 1743 | 7312 | 7329 | SEQ ID 3693 | GAAGGCTCGATCCTGCGA | 1.54 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) Position End | Target Site Sequence ID | Target Site Sequence | Relative Progranulin expression (Relative to PBS) |
|---|---|---|---|---|---|---|---|---|---|
| SEQ ID 2066 | COMP ID 2066 | TCTCGCAGGATCGAGCCT | 1728 | 1745 | 7314 | 7331 | SEQ ID 3694 | AGGCTCGATCCTGCGAGA | 1.55 |
| SEQ ID 2067 | COMP ID 2067 | CTTCTCGCAGGATCGAGC | 1730 | 1747 | 7316 | 7333 | SEQ ID 3695 | GCTCGATCCTGCGAGAAG | 1.54 |
| SEQ ID 2068 | COMP ID 2068 | TCCTTCTCGCAGGATCGA | 1732 | 1749 | 7318 | 7335 | SEQ ID 3696 | TCGATCCTGCGAGAAGGA | 1.53 |
| SEQ ID 2069 | COMP ID 2069 | CTTCCTTCTCGCAGGATC | 1734 | 1751 | 7320 | 7337 | SEQ ID 3697 | GATCCTGCGAGAAGGAAG | 1.21 |
| SEQ ID 2070 | COMP ID 2070 | CACTTCCTTCTCGCAGGA | 1736 | 1753 | 7322 | 7339 | SEQ ID 3698 | TCCTGCGAGAAGGAAGTG | 1.89 |
| SEQ ID 2071 | COMP ID 2071 | ACCACTTCCTTCTCGCAG | 1738 | 1755 | 7324 | 7341 | SEQ ID 3699 | CTGCGAGAAGGAAGTGGT | 1.49 |
| SEQ ID 2072 | COMP ID 2072 | AGACCACTTCCTTCTCGC | 1740 | 1757 | 7326 | 7343 | SEQ ID 3700 | GCGAGAAGGAAGTGGTCT | 1.54 |
| SEQ ID 2073 | COMP ID 2073 | AGAGACCACTTCCTTCTC | 1742 | 1759 | 7328 | 7345 | SEQ ID 3701 | GAGAAGGAAGTGGTCTCT | 1.52 |
| SEQ ID 2074 | COMP ID 2074 | GCAGAGACCACTTCCTTC | 1744 | 1761 | 7330 | 7347 | SEQ ID 3702 | GAAGGAAGTGGTCTCTGC | 1.38 |
| SEQ ID 2075 | COMP ID 2075 | GGGCAGAGACCACTTCCT | 1746 | 1763 | 7332 | 7349 | SEQ ID 3703 | AGGAAGTGGTCTCTGCCC | 1.54 |
| SEQ ID 2076 | COMP ID 2076 | CTGGGCAGAGACCACTTC | 1748 | 1765 | 7334 | 7351 | SEQ ID 3704 | GAAGTGGTCTCTGCCCAG | 1.5 |
| SEQ ID 2077 | COMP ID 2077 | GGCTGGGCAGAGACCACT | 1750 | 1767 | 7336 | 7353 | SEQ ID 3705 | AGTGGTCTCTGCCCAGCC | 1.37 |
| SEQ ID 2078 | COMP ID 2078 | CAGGCTGGGCAGAGACCA | 1752 | 1769 | 7338 | 7355 | SEQ ID 3706 | TGGTCTCTGCCCAGCCTG | 1.24 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 2079 | COMP ID 2079 | GGCAGGCTGGGCAGAGAC | 1754 | 1771 | 7340 | 7357 | SEQ ID 3707 | GTCTCTGCCCAGCTGCC | 1.59 |
| SEQ ID 2080 | COMP ID 2080 | GTGGCAGGCTGGGCAGAG | 1756 | 1773 | 7342 | 7359 | SEQ ID 3708 | CTCTGCCCAGCCTGCCAC | 1.83 |
| SEQ ID 2081 | COMP ID 2081 | AGGTGGCAGGCTGGGCAG | 1758 | 1775 | 7344 | 7361 | SEQ ID 3709 | CTGCCCAGCCTGCCACCT | 2.4 |
| SEQ ID 2082 | COMP ID 2082 | GAAGGTGGCAGGCTGGGC | 1760 | 1777 | 7346 | 7363 | SEQ ID 3710 | GCCCAGCCTGCCACCTTC | 2.38 |
| SEQ ID 2083 | COMP ID 2083 | AGGAAGGTGGCAGGCTGG | 1762 | 1779 | 7348 | 7365 | SEQ ID 3711 | CCAGCCTGCCACCTTCCT | 2.34 |
| SEQ ID 2084 | COMP ID 2084 | CCAGGAAGGTGGCAGGCT | 1764 | 1781 | 7350 | 7367 | SEQ ID 3712 | AGCCTGCCACCTTCCTGG | 1.97 |
| SEQ ID 2085 | COMP ID 2085 | GGCCAGGAAGGTGGCAGG | 1766 | 1783 | 7352 | 7369 | SEQ ID 3713 | CCTGCCACCTTCCTGGCC | 1.51 |
| SEQ ID 2086 | COMP ID 2086 | CGGGCCAGGAAGGTGGCA | 1768 | 1785 | 7354 | 7371 | SEQ ID 3714 | TGCCACCTTCCTGGCCCG | 1.58 |
| SEQ ID 2087 | COMP ID 2087 | TACGGGCCAGGAAGGTGG | 1770 | 1787 | 7356 | 7373 | SEQ ID 3715 | CCACCTTCCTGGCCCGTA | 1.54 |
| SEQ ID 2088 | COMP ID 2088 | GCTACGGGCCAGGAAGGT | 1772 | 1789 | 7358 | 7375 | SEQ ID 3716 | ACCTTCCTGGCCCGTAGC | 1.96 |
| SEQ ID 2089 | COMP ID 2089 | GGGCTACGGGCCAGGAAG | 1774 | 1791 | 7360 | 7377 | SEQ ID 3717 | CTTCCTGGCCCGTAGCCC | 1.89 |
| SEQ ID 2090 | COMP ID 2090 | GAGGGCTACGGGCCAGGA | 1776 | 1793 | 7362 | 7379 | SEQ ID 3718 | TCCTGGCCCGTAGCCCTC | 1.81 |
| SEQ ID 2091 | COMP ID 2091 | GTGAGGGCTACGGGCCAG | 1778 | 1795 | 7364 | 7381 | SEQ ID 3719 | CTGGCCCGTAGCCCTCAC | 1.54 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position End Position | Precursor-mRNA Position (SEQ ID NO 3949) Start Position | Precursor-mRNA Position End Position | Target Site Sequence ID | Target Site Sequence | Relative Progranulin expression (Relative to PBS) |
|---|---|---|---|---|---|---|---|---|---|
| SEQ ID 2092 | COMP ID 2092 | ACGTGAGGGCTACGGGCC | 1780 | 1797 | 7366 | 7383 | SEQ ID 3720 | GGCCCGTAGCCCTCACGT | 1.6 |
| SEQ ID 2093 | COMP ID 2093 | CCACGTGAGGGCTACGGG | 1782 | 1799 | 7368 | 7385 | SEQ ID 3721 | CCCGTAGCCCTCACGTGG | 2.07 |
| SEQ ID 2094 | COMP ID 2094 | ACCCACGTGAGGGCTACG | 1784 | 1801 | 7370 | 7387 | SEQ ID 3722 | CGTAGCCCTCACGTGGGT | 1.51 |
| SEQ ID 2095 | COMP ID 2095 | ACACCCACGTGAGGGCTA | 1786 | 1803 | 7372 | 7389 | SEQ ID 3723 | TAGCCCTCACGTGGGTGT | 1.95 |
| SEQ ID 2096 | COMP ID 2096 | TCACACCCACGTGAGGGC | 1788 | 1805 | 7374 | 7391 | SEQ ID 3724 | GCCCTCACGTGGGTGTGA | 1.32 |
| SEQ ID 2097 | COMP ID 2097 | CTTCACACCCACGTGAGG | 1790 | 1807 | 7376 | 7393 | SEQ ID 3725 | CCTCACGTGGGTGTGAAG | 1.94 |
| SEQ ID 2098 | COMP ID 2098 | TCCTTCACACCCACGTGA | 1792 | 1809 | 7378 | 7395 | SEQ ID 3726 | TCACGTGGGTGTGAAGGA | 1.31 |
| SEQ ID 2099 | COMP ID 2099 | CGTCCTTCACACCCACGT | 1794 | 1811 | 7380 | 7397 | SEQ ID 3727 | ACGTGGGTGTGAAGGACG | 1.08 |
| SEQ ID 2100 | COMP ID 2100 | CACGTCCTTCACACCCAC | 1796 | 1813 | 7382 | 7399 | SEQ ID 3728 | GTGGGTGTGAAGGACGTG | 0.95 |
| SEQ ID 2101 | COMP ID 2101 | TCCACGTCCTTCACACCC | 1798 | 1815 | 7384 | 7401 | SEQ ID 3729 | GGGTGTGAAGGACGTGGA | 1.16 |
| SEQ ID 2102 | COMP ID 2102 | ACTCCACGTCCTTCACAC | 1800 | 1817 | 7386 | 7403 | SEQ ID 3730 | GTGTGAAGGACGTGGAGT | 1.05 |
| SEQ ID 2103 | COMP ID 2103 | ACACTCCACGTCCTTCAC | 1802 | 1819 | 7388 | 7405 | SEQ ID 3731 | GTGAAGGACGTGGAGTGT | 1.35 |
| SEQ ID 2104 | COMP ID 2104 | CCACACTCCACGTCCTTC | 1804 | 1821 | 7390 | 7407 | SEQ ID 3732 | GAAGGACGTGGAGTGTGG | 1.02 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every $2^{nd}$ or $3^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | End Position | Precursor-mRNA Position (SEQ ID NO 3949) Start Position | End Position | Target Site Sequence ID | Target Site Sequence | Relative Progranulin expression (Relative to PBS) |
|---|---|---|---|---|---|---|---|---|---|
| SEQ ID 2105 | COMP ID 2105 | CCCCACACTCCAGTCCT | 1806 | 1823 | 7392 | 7409 | SEQ ID 3733 | AGGACGTGGAGTGTGGGG | 1.2 |
| SEQ ID 2106 | COMP ID 2106 | TTCCCCACACTCCACGTC | 1808 | 1825 | 7394 | 7411 | SEQ ID 3734 | GACGTGGAGTGTGGGGAA | 1.18 |
| SEQ ID 2107 | COMP ID 2107 | CCTTCCCCACACTCCACG | 1810 | 1827 | 7396 | 7413 | SEQ ID 3735 | CGTGGAGTGTGGGGAAGG | 1.1 |
| SEQ ID 2108 | COMP ID 2108 | GTCCTTCCCCACACTCCA | 1812 | 1829 | 7398 | 7415 | SEQ ID 3736 | TGGAGTGTGGGGAAGGAC | 1.36 |
| SEQ ID 2109 | COMP ID 2109 | GTGTCCTTCCCCACACTC | 1814 | 1831 | 7400 | 7417 | SEQ ID 3737 | GAGTGTGGGGAAGGACAC | 1.45 |
| SEQ ID 2110 | COMP ID 2110 | AAGTGTCCTTCCCCACAC | 1816 | 1833 | 7402 | 7419 | SEQ ID 3738 | GTGTGGGGAAGGACACTT | 1.26 |
| SEQ ID 2111 | COMP ID 2111 | AGAAGTGTCCTTCCCCAC | 1818 | 1835 | 7404 | 7421 | SEQ ID 3739 | GTGGGGAAGGACACTTCT | 1.44 |
| SEQ ID 2112 | COMP ID 2112 | GCAGAAGTGTCCTTCCCC | 1820 | 1837 | 7406 | 7423 | SEQ ID 3740 | GGGGAAGGACACTTCTGC | 1.16 |
| SEQ ID 2113 | COMP ID 2113 | TGGCAGAAGTGTCCTTCC | 1822 | 1839 | 7408 | 7425 | SEQ ID 3741 | GGAAGGACACTTCTGCCA | 1.42 |
| SEQ ID 2114 | COMP ID 2114 | CATGGCAGAAGTGTCCTT | 1824 | 1841 | 7410 | 7427 | SEQ ID 3742 | AAGGACACTTCTGCCATG | 1.12 |
| SEQ ID 2115 | COMP ID 2115 | ATCATGGCAGAAGTGTCC | 1826 | 1843 | 7412 | 7429 | SEQ ID 3743 | GGACACTTCTGCCATGAT | 1.44 |
| SEQ ID 2116 | COMP ID 2116 | TTATCATGGCAGAAGTGT | 1828 | 1845 | 7414 | 7431 | SEQ ID 3744 | ACACTTCTGCCATGATAA | 1.57 |
| SEQ ID 2117 | COMP ID 2117 | GGTTATCATGGCAGAAGT | 1830 | 1847 | 7416 | 7433 | SEQ ID 3745 | ACTTCTGCCATGATAACC | 1.48 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 2118 | COMP ID 2118 | CTGGTTATCATGGCAGAA | 1832 | 1849 | 7418 | 7435 | SEQ ID 3746 | TTCTGCCATGATAACCAG | 1.49 |
| SEQ ID 2119 | COMP ID 2119 | GTCTGGTTATCATGGCAG | 1834 | 1851 | 7420 | 7437 | SEQ ID 3747 | CTGCCATGATAACCAGAC | 1.72 |
| SEQ ID 2120 | COMP ID 2120 | AGGTCTGGTTATCATGGC | 1836 | 1853 | 7422 | 7439 | SEQ ID 3748 | GCCATGATAACCAGACCT | 1.71 |
| SEQ ID 2121 | COMP ID 2121 | GCAGGTCTGGTTATCATG | 1838 | 1855 | 7424 | 7441 | SEQ ID 3749 | CATGATAACCAGACCTGC | 1.59 |
| SEQ ID 2122 | COMP ID 2122 | CAGCAGGTCTGGTTATCA | 1840 | 1857 | 7426 | 7443 | SEQ ID 3750 | TGATAACCAGACCTGCTG | 1.56 |
| SEQ ID 2123 | COMP ID 2123 | GGCAGCAGGTCTGGTTAT | 1842 | 1859 | 7428 | 7445 | SEQ ID 3751 | ATAACCAGACCTGCTGCC | 1.54 |
| SEQ ID 2124 | COMP ID 2124 | TCGGCAGCAGGTCTGGTT | 1844 | 1861 | 7430 | 7447 | SEQ ID 3752 | AACCAGACCTGCTGCCGA | 1.89 |
| SEQ ID 2125 | COMP ID 2125 | TCTCGGCAGCAGGTCTGG | 1846 | 1863 | 7432 | 449 | SEQ ID 3753 | CCAGACCTGCTGCCGAGA | 1.54 |
| SEQ ID 2126 | COMP ID 2126 | TGTCTCGGCAGCAGGTCT | 1848 | 1865 | 7434 | 7451 | SEQ ID 3754 | AGACCTGCTGCCGAGACA | 1.58 |
| SEQ ID 2127 | COMP ID 2127 | GTTGTCTCGGCAGCAGGT | 1850 | 1867 | 7436 | 7453 | SEQ ID 3755 | ACCTGCTGCCGAGACAAC | 1.58 |
| SEQ ID 2128 | COMP ID 2128 | CGGTTGTCTCGGCAGCAG | 1852 | 1869 | 7438 | 7455 | SEQ ID 3756 | CTGCTGCCGAGACAACCG | no data |
| SEQ ID 2129 | COMP ID 2129 | GTCGGTTGTCTCGGCAGC | 1854 | 1871 | 7440 | 7457 | SEQ ID 3757 | GCTGCCGAGACAACCGAC | no data |
| SEQ ID 2130 | COMP ID 2130 | CTGTCGGTTGTCTCGGCA | 1856 | 1873 | 7442 | 7459 | SEQ ID 3758 | TGCCGAGACAACCGACAG | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 2131 | COMP ID 2131 | CCCTGTCGGTTGTCTCGG | 1858 | 1875 | 7444 | 7461 | SEQ ID 3759 | CCGAGACAACCGACAGGG | no data |
| SEQ ID 2132 | COMP ID 2132 | AGCCCTGTCGGTTGTCTC | 1860 | 1877 | 7446 | 7463 | SEQ ID 3760 | GAGACAACCGACAGGGCT | no data |
| SEQ ID 2133 | COMP ID 2133 | CCAGCCCTGTCGGTTGTC | 1862 | 1879 | 7448 | 7465 | SEQ ID 3761 | GACAACCGACAGGGCTGG | no data |
| SEQ ID 2134 | COMP ID 2134 | GCCCAGCCCTGTCGGTTG | 1864 | 1881 | 7450 | 7467 | SEQ ID 3762 | CAACCGACAGGGCTGGGC | no data |
| SEQ ID 2135 | COMP ID 2135 | AGGGCCCAGCCCTGTCGGT | 1866 | 1883 | 7452 | 7469 | SEQ ID 3763 | ACCGACAGGGCTGGGCCT | no data |
| SEQ ID 2136 | COMP ID 2136 | GCAGGGCCCAGCCCTGTCG | 1868 | 1885 | 7454 | 7471 | SEQ ID 3764 | CGACAGGGCTGGGCCTGC | no data |
| SEQ ID 2137 | COMP ID 2137 | CAGCAGGGCCCAGCCCTGT | 1870 | 1887 | 7456 | 7473 | SEQ ID 3765 | ACAGGGCTGGGCCTGCTG | no data |
| SEQ ID 2138 | COMP ID 2138 | GACAGCAGGGCCCAGCCCT | 1872 | 1889 | 7458 | 7475 | SEQ ID 3766 | AGGGCTGGGCCTGCTGTC | no data |
| SEQ ID 2139 | COMP ID 2139 | GGGACAGCAGGGCCCAGCC | 1874 | 1891 | 7460 | 7477 | SEQ ID 3767 | GGCTGGGCCTGCTGTCCC | no data |
| SEQ ID 2140 | COMP ID 2140 | TAGGGACAGCAGGCCCAG | 1876 | 1893 | 7462 | 7479 | SEQ ID 3768 | CTGGGCCTGCTGTCCCTA | no data |
| SEQ ID 2141 | COMP ID 2141 | GGTAGGGACAGCAGGCCC | 1878 | 1895 | 7464 | 7481 | SEQ ID 3769 | GGGCCTGCTGTCCCTACC | no data |
| SEQ ID 2142 | COMP ID 2142 | GCCGTAGGGACAGCAGGC | 1880 | 1897 | 7466 | 7483 | SEQ ID 3770 | GCCTGCTGTCCCTACCGC | no data |
| SEQ ID 2143 | COMP ID 2143 | TGGCGGTAGGGACAGCAG | 1882 | 1899 | 7468 | 7485 | SEQ ID 3771 | CTGTGTCCCTACCGCCA | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) Position End | Target Site Sequence ID | Target Site Sequence | Relative Progranulin expression (Relative to PBS) |
|---|---|---|---|---|---|---|---|---|---|
| SEQ ID 2144 | COMP ID 2144 | ATGGGGTTGGCACTGAC | | | 7487 | 7504 | SEQ ID 3772 | GTCAGTGCCAACCCCAT | no data |
| SEQ ID 2145 | COMP ID 2145 | GGATGGGGTTGGCACTG | | | 7489 | 506 | SEQ ID 3773 | CAGTGCCAACCCCATCC | no data |
| SEQ ID 2146 | COMP ID 2146 | CAGGATGGGGTTGGCAC | | | 7491 | 7508 | SEQ ID 3774 | GTGCCAACCCCATCCTG | 2.44 |
| SEQ ID 2147 | COMP ID 2147 | CCCAGGATGGGGTTGGC | | | 7493 | 7510 | SEQ ID 3775 | GCCAACCCCATCCTGGG | 1.56 |
| SEQ ID 2148 | COMP ID 2148 | GCCCCAGGATGGGGTTG | | | 7495 | 7512 | SEQ ID 3776 | CAACCCCATCCTGGGGC | 1.74 |
| SEQ ID 2149 | COMP ID 2149 | CAGCCCCAGGATGGGGT | | | 7497 | 7514 | SEQ ID 3777 | ACCCCATCCTGGGCTG | 1.31 |
| SEQ ID 2150 | COMP ID 2150 | CCCAGCCCCAGGATGGG | | | 7499 | 7516 | SEQ ID 3778 | CCCCATCCTGGGGCTGGG | 1.38 |
| SEQ ID 2151 | COMP ID 2151 | TACCCAGCCCCAGGATGG | | | 7501 | 7518 | SEQ ID 3779 | CCATCCTGGGGCTGGGTA | 1.22 |
| SEQ ID 2152 | COMP ID 2152 | CATACCCAGCCCCAGGAT | | | 7503 | 7520 | SEQ ID 3780 | ATCCTGGGGCTGGGTATG | 1.33 |
| SEQ ID 2153 | COMP ID 2153 | GCCATACCCAGCCCCAGG | | | 7505 | 7522 | SEQ ID 3781 | CCTGGGGCTGGGTATGGC | 1.15 |
| SEQ ID 2154 | COMP ID 2154 | TGGCCATACCCAGCCCCA | | | 7507 | 7524 | SEQ ID 3782 | TGGGGCTGGGTATGGCCA | 1.39 |
| SEQ ID 2155 | COMP ID 2155 | CCTGGGCCATACCCAGCCC | | | 7509 | 7526 | SEQ ID 3783 | GGGCTGGGTATGGCCAGG | 1.13 |
| SEQ ID 2156 | COMP ID 2156 | TCCCTGGGCCATACCCAGC | | | 7511 | 7528 | SEQ ID 3784 | GCTGGGTATGGCCAGGGA | 1.46 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Position Sequence ID | Target Site Sequence | Relative Progranulin expression (Relative to PBS) |
|---|---|---|---|---|---|---|---|---|---|
| SEQ ID 2157 | COMP ID 2157 | GGTCCCTGGCCATACCCA | | | 7513 | 7530 | SEQ ID 3785 | TGGGTATGGCCAGGGACC | 1.1 |
| SEQ ID 2158 | COMP ID 2158 | CTGGTCCCTGGCCATACC | | | 7515 | 7532 | SEQ ID 3786 | GGTATGGCCAGGGACCAG | 1.5 |
| SEQ ID 2159 | COMP ID 2159 | ACCTGGTCCCTGGCCATA | | | 7517 | 7534 | SEQ ID 3787 | TATGGCCAGGGACCAGGT | 1.16 |
| SEQ ID 2160 | COMP ID 2160 | GGACCTGGTCCCTGGCCA | | | 7519 | 7536 | SEQ ID 3788 | TGGCCAGGGACCAGGTCC | 2.1 |
| SEQ ID 2161 | COMP ID 2161 | GAGGTGGGACCTGGTCCC | | | 7525 | 7542 | SEQ ID 3789 | GGGACCAGGTCCCACCTC | 1.45 |
| SEQ ID 2162 | COMP ID 2162 | ACGAGGTGGGACCTGGTC | | | 7527 | 7544 | SEQ ID 3790 | GACCAGGTCCCACCTCGT | 1.86 |
| SEQ ID 2163 | COMP ID 2163 | GGACGAGGTGGGACCTGG | | | 7529 | 7546 | SEQ ID 3791 | CCAGGTCCCACCTCGTCC | 1.63 |
| SEQ ID 2164 | COMP ID 2164 | TTGGACGAGGTGGGACCT | | | 7531 | 7548 | SEQ ID 3792 | AGGTCCCACCTCGTCCAA | 1.49 |
| SEQ ID 2165 | COMP ID 2165 | GGTTGGACGAGGTGGGAC | | | 7533 | 7550 | SEQ ID 3793 | GTCCCACCTCGTCCAACC | 1.86 |
| SEQ ID 2166 | COMP ID 2166 | AGGGTTGGACGAGGTGGG | | | 7535 | 7552 | SEQ ID 3794 | CCCACCTCGTCCAACCCT | 2.12 |
| SEQ ID 2167 | COMP ID 2167 | AGAGGGTTGGACGAGGTG | | | 7537 | 7554 | SEQ ID 3795 | CACCTCGTCCAACCCTCT | 1.83 |
| SEQ ID 2168 | COMP ID 2168 | CGAGAGGGTTGGACGAGG | | | 7539 | 7556 | SEQ ID 3796 | CCTCGTCCAACCCTCTCG | 1.98 |
| SEQ ID 2169 | COMP ID 2169 | GGCGAGAGGGTTGGACGA | | | 7541 | 7558 | SEQ ID 3797 | TCGTCCAACCCTCTCGCC | 1.79 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Position (SEQ ID NO 1) Start Position | Mature mRNA Position (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 2170 | COMP ID 2170 | GGGGCGAGAGGGTTGGAC | | | 7543 | 7560 | SEQ ID 3798 | GTCCAACCCTCTCGCCCC | 2.44 |
| SEQ ID 2171 | COMP ID 2171 | GGGGGGCCAGAGGGTTGG | | | 7545 | 7562 | SEQ ID 3799 | CCAACCCTCTCGCCCCCC | 2.34 |
| SEQ ID 2172 | COMP ID 2172 | GAGGGGGCGAGAGGGTT | | | 7547 | 7564 | SEQ ID 3800 | AACCCTCTCGCCCCCCTC | 2.15 |
| SEQ ID 2173 | COMP ID 2173 | CAGAGGGGCGAGAGGG | | | 7549 | 7566 | SEQ ID 3801 | CCCTCTCGCCCCCCTCTG | 2.09 |
| SEQ ID 2174 | COMP ID 2174 | GTCAGAGGGGCGAGAG | | | 7551 | 7568 | SEQ ID 3802 | CTCTCGCCCCCCTCTGAC | 2.16 |
| SEQ ID 2175 | COMP ID 2175 | TGGTCAGAGGGGGCGAG | | | 7553 | 7570 | SEQ ID 3803 | CTCGCCCCCCTCTGACCA | 2.56 |
| SEQ ID 2176 | COMP ID 2176 | GATGGTCAGAGGGGGCG | | | 7555 | 7572 | SEQ ID 3804 | CGCCCCCCTCTGACCATC | 2.36 |
| SEQ ID 2177 | COMP ID 2177 | TGGATGGTCAGAGGGGG | | | 7557 | 7574 | SEQ ID 3805 | CCCCCCTCTGACCATCCA | 2.84 |
| SEQ ID 2178 | COMP ID 2178 | ATCAGCAACAGACGCC | 1901 | 1918 | 7576 | 7593 | SEQ ID 3806 | GGCGTCTGTTGTGCTGAT | 1.13 |
| SEQ ID 2179 | COMP ID 2179 | CGATCAGCACAACAGACG | 1903 | 1920 | 7578 | 7595 | SEQ ID 3807 | CGTCTGTTGTGCTGATCG | 1.26 |
| SEQ ID 2180 | COMP ID 2180 | GCCCGATCAGCACAACAGA | 1905 | 1922 | 7580 | 7597 | SEQ ID 3808 | TCTGTTGTGCTGATCGGC | 1.43 |
| SEQ ID 2181 | COMP ID 2181 | GCGCCGATCAGCACAACA | 1907 | 1924 | 7582 | 7599 | SEQ ID 3809 | TGTTGTGCTGATCGGCGC | 1.83 |
| SEQ ID 2182 | COMP ID 2182 | TGGCGCCGATCAGCACAA | 1909 | 1926 | 7584 | 7601 | SEQ ID 3810 | TTGTGCTGATCGGCGCCA | 1.59 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 2183 | COMP ID 2183 | AGTGGCGCCGATCAGCAC | 1911 | 1928 | 7586 | 7603 | SEQ ID 3811 | GTGCTGATCGGCGCCACT | 1.86 |
| SEQ ID 2184 | COMP ID 2184 | GCAGTGGCGCCGATCAGC | 1913 | 1930 | 7588 | 7605 | SEQ ID 3812 | GCTGATCGGCGCCACTGC | 1.73 |
| SEQ ID 2185 | COMP ID 2185 | CAGCAGTGGCGCCGATCA | 1915 | 1932 | 7590 | 7607 | SEQ ID 3813 | TGATCGGCGCCACTGCTG | 1.63 |
| SEQ ID 2186 | COMP ID 2186 | GACAGCAGTGGCGCCGAT | 1917 | 1934 | 7592 | 7609 | SEQ ID 3814 | ATCGGCGCCACTGCTGTC | 1.67 |
| SEQ ID 2187 | COMP ID 2187 | AGGACAGCAGTGGCGCCG | 1919 | 1936 | 7594 | 7611 | SEQ ID 3815 | CGGCGCCACTGCTGTCCT | 1.63 |
| SEQ ID 2188 | COMP ID 2188 | GCAGGACAGCAGTGGCGC | 1921 | 1938 | 7596 | 7613 | SEQ ID 3816 | GCGCCACTGCTGTCCTGC | 1.39 |
| SEQ ID 2189 | COMP ID 2189 | CAGCAGGACAGCAGTGGC | 1923 | 1940 | 7598 | 7615 | SEQ ID 3817 | GCCACTGCTGTCCTGCTG | 1.3 |
| SEQ ID 2190 | COMP ID 2190 | GCCAGCAGGACAGCAGTG | 1925 | 1942 | 7600 | 7617 | SEQ ID 3818 | CACTGCTGTCCTGCTGGC | 1.38 |
| SEQ ID 2191 | COMP ID 2191 | AAGCCAGCAGGACAGCAG | 1927 | 1944 | 7602 | 7619 | SEQ ID 3819 | CTGCTGTCCTGCTGGCTT | 1.44 |
| SEQ ID 2192 | COMP ID 2192 | GGAAGCCAGCAGGACAGC | 1929 | 1946 | 7604 | 7621 | SEQ ID 3820 | GCTGTCCTGCTGGCTTCC | 1.23 |
| SEQ ID 2193 | COMP ID 2193 | GCCGGAAGCCAGCAGGACA | 1931 | 1948 | 7606 | 7623 | SEQ ID 3821 | TGTCCTGCTGGCTTCCGC | 1.52 |
| SEQ ID 2194 | COMP ID 2194 | CAGCGGAAGCCAGCAGGA | 1933 | 1950 | 7608 | 7625 | SEQ ID 3822 | TCCTGCTGGCTTCCGCTG | 1.84 |
| SEQ ID 2195 | COMP ID 2195 | CGCAGCGGAAGCCAGCAG | 1935 | 1952 | 7610 | 7627 | SEQ ID 3823 | CTGCTGGCTTCCGCTGCG | 1.59 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 2196 | COMP ID 2196 | TGCCAGCGGAAGCCAGC | 1937 | 1954 | 7612 | 7629 | SEQ ID 3824 | GCTGGCTTCCGCTGCGCA | 2.07 |
| SEQ ID 2197 | COMP ID 2197 | GCTGCGCAGCGGAAGCCA | 1939 | 1956 | 7614 | 7631 | SEQ ID 3825 | TGGCTTCCGCTGCCAGC | 1.6 |
| SEQ ID 2198 | COMP ID 2198 | TGGCTGCGCAGCGGAAGC | 1941 | 1958 | 7616 | 7633 | SEQ ID 3826 | GCTTCCGTGCGCAGCCA | 1.6 |
| SEQ ID 2199 | COMP ID 2199 | CCTGGCTGCGCAGCGGAA | 1943 | 1960 | 7618 | 7635 | SEQ ID 3827 | TTCCGCTGCGCAGCCAGG | 1.74 |
| SEQ ID 2200 | COMP ID 2200 | CCCCTGGCTGCGCAGCGG | 1945 | 1962 | 7620 | 7637 | SEQ ID 3828 | CCGCTGCGCAGCCAGGGG | 1.63 |
| SEQ ID 2201 | COMP ID 2201 | TACCCCTGGCTGCGCAGC | 1947 | 1964 | 7622 | 7639 | SEQ ID 3829 | GCTGCGCAGCCAGGGGTA | 1.39 |
| SEQ ID 2202 | COMP ID 2202 | GGTACCCCTGGCTGCGCA | 1949 | 1966 | 7624 | 7641 | SEQ ID 3830 | TGCGCAGCCAGGGGTACC | 2.25 |
| SEQ ID 2203 | COMP ID 2203 | TTGGTACCCCTGGCTGCG | 1951 | 1968 | 7626 | 7643 | SEQ ID 3831 | CGCAGCCAGGGGTACCAA | 2.09 |
| SEQ ID 2204 | COMP ID 2204 | ACTTGGTACCCCTGGCTG | 1953 | 1970 | 7628 | 7645 | SEQ ID 3832 | CAGCCAGGGGTACCAAGT | 1.69 |
| SEQ ID 2205 | COMP ID 2205 | ACACTTGGTACCCCTGGC | 1955 | 1972 | 7630 | 7647 | SEQ ID 3833 | GCCAGGGGTACCAAGTGT | 1.39 |
| SEQ ID 2206 | COMP ID 2206 | AAACACTTGGTACCCCTG | 1957 | 1974 | 7632 | 7649 | SEQ ID 3834 | CAGGGGTACCAAGTGTTT | 1.63 |
| SEQ ID 2207 | COMP ID 2207 | GCAAACACTTGGTACCCC | 1959 | 1976 | 7634 | 7651 | SEQ ID 3835 | GGGGTACCAAGTGTTTGC | 1.44 |
| SEQ ID 2208 | COMP ID 2208 | GCGCAAACACTTGGTACC | 1961 | 1978 | 7636 | 7653 | SEQ ID 3836 | GGTACCAAGTGTTTGCGC | 1.81 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 2209 | COMP ID 2209 | CTGCGCAAACACTTGGTA | 1963 | 1980 | 7638 | 7655 | SEQ ID 3837 | TACCAAGTGTTTGCGCAG | 2.34 |
| SEQ ID 2210 | COMP ID 2210 | CCCTGCGCAAACACTTGG | 1965 | 1982 | 7640 | 7657 | SEQ ID 3838 | CCAAGTGTTTGCGCAGGG | 1.63 |
| SEQ ID 2211 | COMP ID 2211 | CTCCCTGCGCAAACACTT | 1967 | 1984 | 7642 | 7659 | SEQ ID 3839 | AAGTGTTTGCGCAGGGAG | 1.61 |
| SEQ ID 2212 | COMP ID 2212 | GCCTCCCTGCGCAAACAC | 1969 | 1986 | 7644 | 7661 | SEQ ID 3840 | GTGTTTGCCAGGGAGGC | 1.57 |
| SEQ ID 2213 | COMP ID 2213 | GGGCCTCCCTGCGCAAAC | 1971 | 1988 | 7646 | 7663 | SEQ ID 3841 | GTTTGCGCAGGGAGGCCC | 2.01 |
| SEQ ID 2214 | COMP ID 2214 | CGGGGCCTCCCTGCGCAA | 1973 | 1990 | 7648 | 7665 | SEQ ID 3842 | TTGCGCAGGGAGGCCCCG | 2.03 |
| SEQ ID 2215 | COMP ID 2215 | CGCGGGGCCTCCCTGCGC | 1975 | 1992 | 7650 | 7667 | SEQ ID 3843 | GCGCAGGGAGGCCCCGCG | 0.96 |
| SEQ ID 2216 | COMP ID 2216 | AGCGCGGGGCCTCCCTGC | 1977 | 1994 | 7652 | 7669 | SEQ ID 3844 | GCAGGGAGGCCCCGCGCT | 1.5 |
| SEQ ID 2217 | COMP ID 2217 | CCAGCGCGGGGCCTCCCT | 1979 | 1996 | 7654 | 7671 | SEQ ID 3845 | AGGGAGGCCCCGCGCTGG | no data |
| SEQ ID 2218 | COMP ID 2218 | TCCCAGCGCGGGGCCTCC | 1981 | 1998 | 7656 | 7673 | SEQ ID 3846 | GGAGGCCCCGCGCTGGGA | no data |
| SEQ ID 2219 | COMP ID 2219 | CGTCCCAGCGCGGGGCCT | 1983 | 2000 | 7658 | 7675 | SEQ ID 3847 | AGGCCCCGCGCTGGGACG | no data |
| SEQ ID 2220 | COMP ID 2220 | GGGCGTCCCAGCGCGGGGC | 1985 | 2002 | 7660 | 7677 | SEQ ID 3848 | GCCCCGCGCTGGGACGCC | 1.39 |
| SEQ ID 2221 | COMP ID 2221 | GGGGCGTCCCAGCGCGGG | 1987 | 2004 | 7662 | 7679 | SEQ ID 3849 | CCCCGCGCTGGGACGCCC | no data |
| SEQ ID 2222 | COMP ID 2222 | AAGGGGCGTCCCAGCGCG | 1989 | 2006 | 7664 | 7681 | SEQ ID 3850 | CGCCTGGGACGCCCCTT | 1.86 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 2223 | COMP ID 2223 | CAAAGGGGCGGTCCCAGCG | 1991 | 2008 | 7666 | 7683 | SEQ ID 3851 | CGCTGGGACGCCCCTTTG | 1.34 |
| SEQ ID 2224 | COMP ID 2224 | CTCAAAGGGGCGTCCCAG | 1993 | 2010 | 7668 | 7685 | SEQ ID 3852 | CTGGGACGCCCCTTTGAG | 1.51 |
| SEQ ID 2225 | COMP ID 2225 | CCCTCAAAGGGGCGTCCC | 1995 | 2012 | 7670 | 7687 | SEQ ID 3853 | GGGACGCCCCTTTGAGGG | 1.36 |
| SEQ ID 2226 | COMP ID 2226 | GTCCCTCAAAGGGGCGTC | 1997 | 2014 | 7672 | 7689 | SEQ ID 3854 | GACGCCCCTTTGAGGGAC | no data |
| SEQ ID 2227 | COMP ID 2227 | GGGTCCCTCAAAGGGGCG | 1999 | 2016 | 7674 | 7691 | SEQ ID 3855 | CGCCCCTTTGAGGGACCC | no data |
| SEQ ID 2228 | COMP ID 2228 | CTGGGTCCCTCAAAGGGG | 2001 | 2018 | 7676 | 7693 | SEQ ID 3856 | CCCCTTTGAGGGACCCAG | no data |
| SEQ ID 2229 | COMP ID 2229 | GGCTGGGTCCCTCAAAGG | 2003 | 2020 | 7678 | 7695 | SEQ ID 3857 | CCTTTGAGGGACCCAGCC | no data |
| SEQ ID 2230 | COMP ID 2230 | AAGGCTGGGTCCCTCAAA | 2005 | 2022 | 7680 | 7697 | SEQ ID 3858 | TTTGAGGGACCCAGCCTT | no data |
| SEQ ID 2231 | COMP ID 2231 | TCAAGGCTGGGTCCCTCA | 2007 | 2024 | 7682 | 7699 | SEQ ID 3859 | TGAGGGACCCAGCCTTGA | no data |
| SEQ ID 2232 | COMP ID 2232 | TCTTCAAGGCTGGGTCCT | 2009 | 2026 | 7684 | 7701 | SEQ ID 3860 | AGGGACCCAGCCTTGAGA | no data |
| SEQ ID 2233 | COMP ID 2233 | TGTCTCAAGGCTGGGTCC | 2011 | 2028 | 7686 | 7703 | SEQ ID 3861 | GGACCCAGCCTTGAGACA | no data |
| SEQ ID 2234 | COMP ID 2234 | GCTGTCTCAAGGCTGGGT | 2013 | 2030 | 7688 | 7705 | SEQ ID 3862 | ACCCAGCCTTGAGACAGC | no data |
| SEQ ID 2235 | COMP ID 2235 | CAGCTGTCTCAAGGCTGG | 2015 | 2032 | 7690 | 7707 | SEQ ID 3863 | CCAGCCTTGAGACAGCTG | no data |
| SEQ ID 2236 | COMP ID 2236 | AGCAGCTGTCTCAAGGCT | 2017 | 2034 | 7692 | 7709 | SEQ ID 3864 | AGCCTTGAGACAGCTGCT | no data |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 2237 | COMP ID 2237 | ACAGCAGCTGTCTCAAGG | 2019 | 2036 | 7694 | 7711 | SEQ ID 3865 | CCTTGAGACAGCTGCTGT | no data |
| SEQ ID 2238 | COMP ID 2238 | TCACAGCAGCTGTCTCAA | 2021 | 2038 | 7696 | 7713 | SEQ ID 3866 | TTGAGACAGCTGCTGTGA | no data |
| SEQ ID 2239 | COMP ID 2239 | GCCTGCGTCCGACTCCGC | 234 | 251 | | | SEQ ID 3867 | GCGGAGTCGGACGCAGGC | 1.58 |
| SEQ ID 2240 | COMP ID 2240 | CTGCCTGCGTCCGACTCC | 236 | 253 | | | SEQ ID 3868 | GGAGTCGGACGCAGGCAG | 1.56 |
| SEQ ID 2241 | COMP ID 2241 | GTCTGCCTGCGTCCGACT | 238 | 255 | | | SEQ ID 3869 | AGTCGGACGCAGGCAGAC | 1.39 |
| SEQ ID 2242 | COMP ID 2242 | TGGTCTGCCTGCGTCCGA | 240 | 257 | | | SEQ ID 3870 | TCGGACGCAGGCAGACCA | 1.74 |
| SEQ ID 2243 | COMP ID 2243 | CATGGTCTGCCTGCGTCC | 242 | 259 | | | SEQ ID 3871 | GGACGCAGGCAGACCATG | 1.89 |
| SEQ ID 2244 | COMP ID 2244 | CACATGGTCTGCCTGCGT | 244 | 261 | | | SEQ ID 3872 | ACGCAGGCAGACCATGTG | 1.91 |
| SEQ ID 2245 | COMP ID 2245 | TCCAGAAGGGGACGGCAG | 379 | 396 | | | SEQ ID 3873 | CTGCCGTCCCCTTCTGGA | 1.82 |
| SEQ ID 2246 | COMP ID 2246 | TGTCCAGAAGGGGACGGC | 381 | 398 | | | SEQ ID 3874 | GCCGTCCCCTTCTGGACA | 1.57 |
| SEQ ID 2247 | COMP ID 2247 | TTTGTCCAGAAGGGGACG | 383 | 400 | | | SEQ ID 3875 | CGTCCCCTTCTGGACAAA | 1.55 |
| SEQ ID 2248 | COMP ID 2248 | CATTTGTCCAGAAGGGGA | 385 | 402 | | | SEQ ID 3876 | TCCCCTTCTGGACAAATG | 2.73 |
| SEQ ID 2249 | COMP ID 2249 | GCCATTTGTCCAGAAGGG | 387 | 404 | | | SEQ ID 3877 | CCCTTCTGGACAAATGGC | 1.49 |
| SEQ ID 2250 | COMP ID 2250 | GGGCCATTTGTCCAGAAG | 389 | 406 | | | SEQ ID 3878 | CTTCTGGACAAATGGCCC | 1.37 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 2251 | COMP ID 2251 | GTGGGCCATTTGTCCAGA | 391 | 408 | | | SEQ ID 3879 | TCTGACAAATGGCCCAC | 1.51 |
| SEQ ID 2252 | COMP ID 2252 | TTGTGGGCCATTTGTCCA | 393 | 410 | | | SEQ ID 3880 | TGGACAAATGGCCCACAA | 1.59 |
| SEQ ID 2253 | COMP ID 2253 | GGCCTCTGGGAAGGGGCA | 506 | 523 | | | SEQ ID 3881 | TGCCCCTTCCCAGAGGCC | 2.34 |
| SEQ ID 2254 | COMP ID 2254 | ACGGCCTCTGGGAAGGGG | 508 | 525 | | | SEQ ID 3882 | CCCCTTCCCAGAGGCCGT | 3.92 |
| SEQ ID 2255 | COMP ID 2255 | CCACGGCCTCTGGGAAGG | 510 | 527 | | | SEQ ID 3883 | CCTTCCCAGAGGCCGTGG | 1.88 |
| SEQ ID 2256 | COMP ID 2256 | TGCCACGGCCTCTGGGAA | 512 | 529 | | | SEQ ID 3884 | TTCCCAGAGGCCGTGGCA | 2.05 |
| SEQ ID 2257 | COMP ID 2257 | CATGCCACGGCCTCTGGG | 514 | 531 | | | SEQ ID 3885 | CCCAGAGGCCGTGGCATG | 2.05 |
| SEQ ID 2258 | COMP ID 2258 | CGCATGCCACGGCCTCTG | 516 | 533 | | | SEQ ID 3886 | CAGAGGCCGTGGCATGCG | 2.33 |
| SEQ ID 2259 | COMP ID 2259 | CCCGCATGCCACGGCCTC | 518 | 535 | | | SEQ ID 3887 | GAGGCCGTGGCATGCGGG | 2.29 |
| SEQ ID 2260 | COMP ID 2260 | TTACCTGATCTTTGGAAG | 592 | 609 | | | SEQ ID 3888 | CTTCCAAAGATCAGGTAA | 1.69 |
| SEQ ID 2261 | COMP ID 2261 | TGTTACCTGATCTTTGGA | 594 | 611 | | | SEQ ID 3889 | TCCAAAGATCAGGTAACA | 1.76 |
| SEQ ID 2262 | COMP ID 2262 | GTTGTTACCTGATCTTTG | 596 | 613 | | | SEQ ID 3890 | CAAAGATCAGGTAACAAC | 2.04 |
| SEQ ID 2263 | COMP ID 2263 | GAGTTGTTACCTGATCTT | 598 | 615 | | | SEQ ID 3891 | AAGATCAGGTAACAACTC | 1.93 |
| SEQ ID 2264 | COMP ID 2264 | CGGAGTTGTTACCTGATC | 600 | 617 | | | SEQ ID 3892 | GATCAGGTAACAACTCCG | 1.6 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2$^{nd}$ or 3$^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 2265 | COMP ID 2265 | CACGGAGTTGTTACCTGA | 602 | 619 | | | SEQ ID 3893 | TCAGGTAACAACTCCGTG | 1.88 |
| SEQ ID 2266 | COMP ID 2266 | AGCCTGGGGCATGGGGCA | 704 | 721 | | | SEQ ID 3894 | TGCCCCATGCCCCAGGCT | 3.73 |
| SEQ ID 2267 | COMP ID 2267 | GAAGCCTGGGGCATGGGG | 706 | 723 | | | SEQ ID 3895 | CCCCATGCCCCAGGCTTC | 4.09 |
| SEQ ID 2268 | COMP ID 2268 | AGGAAGCCTGGGCATGG | 708 | 725 | | | SEQ ID 3896 | CCATGCCCCAGGCTTCCT | 1.56 |
| SEQ ID 2269 | COMP ID 2269 | GCAGGAAGCCTGGGGCAT | 710 | 727 | | | SEQ ID 3897 | ATGCCCCAGGCTTCCTGC | 1.61 |
| SEQ ID 2270 | COMP ID 2270 | CAGCAGGAAGCCTGGGGC | 712 | 729 | | | SEQ ID 3898 | GCCCCAGGCTTCCTGCTG | 1.41 |
| SEQ ID 2271 | COMP ID 2271 | CACAGCAGGAAGCCTGGG | 714 | 731 | | | SEQ ID 3899 | CCCAGGCTTCCTGCTGTG | 1.21 |
| SEQ ID 2272 | COMP ID 2272 | ACTGCCCCTGTTAGTCCTC | 838 | 855 | | | SEQ ID 3900 | GAGGACTAACAGGGCAGT | 1.29 |
| SEQ ID 2273 | COMP ID 2273 | CCACTGCCCTGTTAGTCC | 840 | 857 | | | SEQ ID 3901 | GGACTAACAGGGCAGTGG | 1.12 |
| SEQ ID 2274 | COMP ID 2274 | GGCCACTGCCCTGTTAGT | 842 | 859 | | | SEQ ID 3902 | ACTAACAGGGCAGTGGCC | 1.46 |
| SEQ ID 2275 | COMP ID 2275 | AAGGCCCACTGCCCTGTTA | 844 | 861 | | | SEQ ID 3903 | TAACAGGGCAGTGGCCTT | 1.37 |
| SEQ ID 2276 | COMP ID 2276 | ACAAGGCCACTGCCCTGT | 846 | 863 | | | SEQ ID 3904 | ACAGGGCAGTGGCCTTGT | 1.19 |
| SEQ ID 2277 | COMP ID 2277 | GGACAAGGCCACTGCCCT | 848 | 865 | | | SEQ ID 3905 | AGGGCAGTGGCCTTGTCC | 1.48 |
| SEQ ID 2278 | COMP ID 2278 | CTGGACAAGGCCACTGCC | 850 | 867 | | | SEQ ID 3906 | GGCAGTGGCCTTGTCCAG | 1.48 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Position Sequence ID | Target Site Sequence | Relative Progranulin expression (Relative to PBS) |
|---|---|---|---|---|---|---|---|---|---|
| SEQ ID 2279 | COMP ID 2279 | GCGTTGGGCATTGGGCAG | 949 | 966 | | | SEQ ID 3907 | CTGCCCAATGCCCAACGC | 1.39 |
| SEQ ID 2280 | COMP ID 2280 | TGGCGTTGGGCATTGGGC | 951 | 968 | | | SEQ ID 3908 | GCCCAATGCCCAACGCCA | 2.29 |
| SEQ ID 2281 | COMP ID 2281 | GGTGGCGTTGGGCATTGG | 953 | 970 | | | SEQ ID 3909 | CCAATGCCCAACGCCACC | 1.54 |
| SEQ ID 2282 | COMP ID 2282 | CAGGTGGCGTTGGGCATT | 955 | 972 | | | SEQ ID 3910 | AATGCCCAACGCCACCTG | 1.69 |
| SEQ ID 2283 | COMP ID 2283 | AGCAGGTGGCGTTGGGCA | 957 | 974 | | | SEQ ID 3911 | TGCCCAACGCCACCTGCT | 1.53 |
| SEQ ID 2284 | COMP ID 2284 | GCAGCAGGTGGCGTTGGG | 959 | 976 | | | SEQ ID 3912 | CCCAACGCCACCTGCTGC | 1.85 |
| SEQ ID 2285 | COMP ID 2285 | GAGCAGCAGGTGGCGTTG | 961 | 978 | | | SEQ ID 3913 | CAACGCCACCTGCTGCTC | 1.64 |
| SEQ ID 2286 | COMP ID 2286 | CGGAGCAGCAGGTGGCGT | 963 | 980 | | | SEQ ID 3914 | ACGCCACCTGCTGCTCCG | 1.15 |
| SEQ ID 2287 | COMP ID 2287 | ACTGTGTGCGCAGGCAGC | 1075 | 1092 | | | SEQ ID 3915 | GCTGCCTGCGCACACAGT | 1.15 |
| SEQ ID 2288 | COMP ID 2288 | CCACTGTGTGCGCAGGCA | 1077 | 1094 | | | SEQ ID 3916 | TGCCTGCGCACACAGTGG | 1.33 |
| SEQ ID 2289 | COMP ID 2289 | CCCCACTGTGTGCGCAGG | 1079 | 1096 | | | SEQ ID 3917 | CCTGCGCACACAGTGGGG | 1.19 |
| SEQ ID 2290 | COMP ID 2290 | TCCCCACTGTGTGCGCA | 1081 | 1098 | | | SEQ ID 3918 | TGCGCACACAGTGGGGA | 1.41 |
| SEQ ID 2291 | COMP ID 2291 | CATCCCCACTGTGTGCG | 1083 | 1100 | | | SEQ ID 3919 | CGCACACAGTGGGGATG | 1.25 |
| SEQ ID 2292 | COMP ID 2292 | CACATCCCCACTGTGTG | 1085 | 1102 | | | SEQ ID 3920 | CACACAGTGGGGATGTG | 1.15 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every 2nd or 3rd nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 2293 | COMP ID 2293 | GCCTGGGTAAAAGGGCAG | 1174 | 1191 | | | SEQ ID 3921 | CTGCCCTTTTACCCAGGC | 1.3 |
| SEQ ID 2294 | COMP ID 2294 | CAGCCTGGGTAAAAGGGC | 1176 | 1193 | | | SEQ ID 3922 | GCCCTTTTACCCAGGCTG | 1.73 |
| SEQ ID 2295 | COMP ID 2295 | CACAGCCTGGGTAAAAGG | 1178 | 1195 | | | SEQ ID 3923 | CCTTTTACCCAGGCTGTG | 1.74 |
| SEQ ID 2296 | COMP ID 2296 | CACACAGCCTGGGTAAAA | 1180 | 1197 | | | SEQ ID 3924 | TTTTACCCAGGCTGTGTG | 1.19 |
| SEQ ID 2297 | COMP ID 2297 | AGCACACAGCCTGGGTAA | 1182 | 1199 | | | SEQ ID 3925 | TTACCCAGGCTGTGTGCT | 1.16 |
| SEQ ID 2298 | COMP ID 2298 | ACAGCACACAGCCTGGGT | 1184 | 1201 | | | SEQ ID 3926 | ACCCAGGCTGTGTGCTGT | 1.18 |
| SEQ ID 2299 | COMP ID 2299 | TCACAGCACACAGCCTGG | 1186 | 1203 | | | SEQ ID 3927 | CCAGGCTGTGTGCTGTGA | 1.12 |
| SEQ ID 2300 | COMP ID 2300 | GCCTCTGGGATTGGACAG | 1420 | 1437 | | | SEQ ID 3928 | CTGTCCAATCCCAGAGGC | 1.49 |
| SEQ ID 2301 | COMP ID 2301 | CAGCCTCTGGGATTGGAC | 1422 | 1439 | | | SEQ ID 3929 | GTCCAATCCCAGAGGCTG | 1.24 |
| SEQ ID 2302 | COMP ID 2302 | GACAGCCTCTGGGATTGG | 1424 | 1441 | | | SEQ ID 3930 | CCAATCCCAGAGGCTGTC | 1.69 |
| SEQ ID 2303 | COMP ID 2303 | CAGACAGCCTCTGGGATT | 1426 | 1443 | | | SEQ ID 3931 | AATCCCAGAGGCTGTCTG | 1.27 |
| SEQ ID 2304 | COMP ID 2304 | AGCAGACAGCCTCTGGGA | 1428 | 1445 | | | SEQ ID 3932 | TCCCAGAGGCTGTCTGCT | 1.21 |
| SEQ ID 2305 | COMP ID 2305 | GCAGCAGACAGCCTCTGG | 1430 | 1447 | | | SEQ ID 3933 | CCAGAGGCTGTCTGCTGC | 1.19 |
| SEQ ID 2306 | COMP ID 2306 | GAGCAGCAGACAGCCTCT | 1432 | 1449 | | | SEQ ID 3934 | AGAGGCTGTCTGCTGCTC | 1.33 |

TABLE 4-continued

All the antisense oligonucleotides are designed as 18-mers DNA-LNA mixmers with a phosphorothioate backbone, DNA-LNA mixmers with a phosphorothioate backbone, LNA at the very 5' and 3' position and e.g. LNA for every $2^{nd}$ or $3^{rd}$ nucleotide (see Compound table).

| SEQ ID | Compound ID (See Compound Table) | Oligonucleotide Sequence Motif (nucleobase Sequence) | Mature mRNA Postion (SEQ ID NO 1) Start Position | Mature mRNA Postion (SEQ ID NO 1) End Position | Precursor-mRNA Position (SEQ ID NO 3949) Start Position | Precursor-mRNA Position (SEQ ID NO 3949) End Position | Target Site Sequence ID | Target Site Sequence | Relative Progranulin expression (Relative to PBS) |
|---|---|---|---|---|---|---|---|---|---|
| SEQ ID 2307 | COMP ID 2307 | GCATGGGGCAACTGGCAG | 1654 | 1671 | | | SEQ ID 3935 | CTGCCAGTTGCCCCATGC | 1.73 |
| SEQ ID 2308 | COMP ID 2308 | CAGCATGGGGCAACTGGC | 1656 | 1673 | | | SEQ ID 3936 | GCCAGTTGCCCCATGCTG | 2.47 |
| SEQ ID 2309 | COMP ID 2309 | CACAGCATGGGGCAACTG | 1658 | 1675 | | | SEQ ID 3937 | CAGTTGCCCCATGCTGTG | 2.03 |
| SEQ ID 2310 | COMP ID 2310 | CACACAGCATGGGGCAAC | 1660 | 1677 | | | SEQ ID 3938 | GTTGCCCCATGCTGTGTG | 1.74 |
| SEQ ID 2311 | COMP ID 2311 | AGCACAGCATGGGGCA | 1662 | 1679 | | | SEQ ID 3939 | TGCCCCATGCTGTGTGCT | 2.02 |
| SEQ ID 2312 | COMP ID 2312 | GCAGCACACAGCATGGGG | 1664 | 1681 | | | SEQ ID 3940 | CCCCATGCTGTGTGCTGC | 2.29 |
| SEQ ID 2313 | COMP ID 2313 | TCGCAGCACACAGCATGG | 1666 | 1683 | | | SEQ ID 3941 | CCATGCTGTGTGCTGCGA | 1.4 |
| SEQ ID 2314 | COMP ID 2314 | CCTCGCAGCACACAGCAT | 1668 | 1685 | | | SEQ ID 3942 | ATGCTGTGTGCTGCGAGG | 1.31 |
| SEQ ID 2315 | COMP ID 2315 | CCCTGGGCGGTAGGGACAG | 1885 | 1902 | | | SEQ ID 3943 | CTGTCCCTACCGCCAGGG | 1.34 |
| SEQ ID 2316 | COMP ID 2316 | CGCCCTGGCGGTAGGGAC | 1887 | 1904 | | | SEQ ID 3944 | GTCCCTACCGCCAGGGCG | 1.56 |
| SEQ ID 2317 | COMP ID 2317 | GACCCCTGGCGGTAGGG | 1889 | 1906 | | | SEQ ID 3945 | CCCTACCGCCAGGGCGTC | 4.23 |
| SEQ ID 2318 | COMP ID 2318 | CAGAGCGCCCTGGCGGTAG | 1891 | 1908 | | | SEQ ID 3946 | CTACCGCCAGGGCGTCTG | 3.09 |
| SEQ ID 2319 | COMP ID 2319 | AACAGACGCCCTGGCGGT | 1893 | 1910 | | | SEQ ID 3947 | ACCGCCAGGGCGTCTGTT | 1.85 |
| SEQ ID 2320 | COMP ID 2320 | ACAACAGACGCCCTGGCG | 1895 | 1912 | | | SEQ ID 3948 | CGCCAGGGCGTCTGTTGT | 1.61 |

| SEQ ID | HELM, 5' - 3' direction |
|---|---|
| SEQ ID 3 | [LR]([5meC])[sP] · [dR](C)[sP] · [dR](T)[sP] · [LR](G)[sP] · [dR](C)[sP] · [dR](T)[sP] · [LR](T)[sP] · [dR](C)[sP] · [dR](C)[sP] · [LR](T)[sP] · [dR](C)[sP] · [LR](T)[sP] · [dR]([5meC])[sP] · [dR](G)[sP] · [LR]([5meC])[sP] · [LR]([5meC]) |
| SEQ ID 4 | [LR]([5meC])[sP] · [dR](C)[sP] · [LR]([5meC])[sP] · [dR](T)[sP] · [LR](G)[sP] · [dR](C)[sP] · [dR](T)[sP] · [LR](T)[sP] · [dR](C)[sP] · [dR](C)[sP] · [LR](T)[sP] · [dR](C)[sP] · [LR](T)[sP] · [dR](C)[sP] · [LR](G)[sP] · [LR]([5meC]) |
| SEQ ID 5 | [LR](T)[sP] · [dR](C)[sP] · [LR]([5meC])[sP] · [dR](C)[sP] · [dR](T)[sP] · [LR](G)[sP] · [dR](C)[sP] · [LR](T)[sP] · [dR](T)[sP] · [dR](C)[sP] · [LR](T)[sP] · [dR](C)[sP] · [dR](T)[sP] · [LR]([5meC])[sP] · [LR](G) |
| SEQ ID 6 | [LR]([5meC])[sP] · [dR](T)[sP] · [dR](C)[sP] · [LR]([5meC])[sP] · [dR](C)[sP] · [dR](T)[sP] · [LR](G)[sP] · [dR](C)[sP] · [dR](T)[sP] · [LR](T)[sP] · [dR](C)[sP] · [dR](C)[sP] · [LR](T)[sP] · [dR](C)[sP] · [LR]([5meC]) |
| SEQ ID 7 | [LR]([5meC])[sP] · [dR](C)[sP] · [LR](T)[sP] · [dR](C)[sP] · [LR]([5meC])[sP] · [dR](C)[sP] · [dR](T)[sP] · [LR](G)[sP] · [dR](C)[sP] · [dR](T)[sP] · [LR](T)[sP] · [dR](C)[sP] · [LR]([5meC])[sP] · [dR](T)[sP] · [LR]([5meC])[sP] · [LR](T) |
| SEQ ID 8 | [LR](T)[sP] · [dR](C)[sP] · [dR](C)[sP] · [LR](T)[sP] · [dR](C)[sP] · [LR]([5meC])[sP] · [dR](C)[sP] · [dR](T)[sP] · [LR](G)[sP] · [dR](C)[sP] · [dR](T)[sP] · [LR](T)[sP] · [dR](C)[sP] · [dR](C)[sP] · [LR](T)[sP] · [LR]([5meC]) |
| SEQ ID 9 | [LR]([5meC])[sP] · [dR](C)[sP] · [LR](T)[sP] · [dR](C)[sP] · [LR]([5meC])[sP] · [dR](C)[sP] · [dR](T)[sP] · [LR](G)[sP] · [dR](C)[sP] · [dR](T)[sP] · [LR](G)[sP] · [dR](C)[sP] · [dR](T)[sP] · [LR](T)[sP] · [dR](C)[sP] · [LR]([5meC])[sP] · [LR](T) |
| SEQ ID 10 | [LR](T)[sP] · [dR](C)[sP] · [LR](T)[sP] · [dR](C)[sP] · [dR](C)[sP] · [LR](T)[sP] · [dR](C)[sP] · [LR]([5meC])[sP] · [dR](C)[sP] · [dR](T)[sP] · [LR](G)[sP] · [dR](C)[sP] · [dR](T)[sP] · [LR](T)[sP] · [dR](C)[sP] · [LR]([5meC]) |
| SEQ ID 11 | [LR]([5meC])[sP] · [dR](T)[sP] · [dR](C)[sP] · [LR](T)[sP] · [dR](C)[sP] · [dR](C)[sP] · [LR](T)[sP] · [dR](C)[sP] · [LR]([5meC])[sP] · [dR](C)[sP] · [dR](T)[sP] · [LR](G)[sP] · [dR](C)[sP] · [dR](T)[sP] · [LR](T)[sP] · [LR]([5meC]) |
| SEQ ID 12 | [LR](A)[sP] · [dR](C)[sP] · [LR](T)[sP] · [dR](C)[sP] · [LR](T)[sP] · [dR](C)[sP] · [dR](C)[sP] · [LR](T)[sP] · [dR](C)[sP] · [LR]([5meC])[sP] · [dR](C)[sP] · [dR](T)[sP] · [LR](G)[sP] · [dR](C)[sP] · [LR](T)[sP] · [LR](T) |
| SEQ ID 13 | [LR]([5meC])[sP] · [dR](A)[sP] · [dR](C)[sP] · [LR](T)[sP] · [dR](C)[sP] · [LR](T)[sP] · [dR](C)[sP] · [dR](C)[sP] · [LR](T)[sP] · [dR](C)[sP] · [dR](C)[sP] · [LR]([5meC])[sP] · [dR](T)[sP] · [dR](G)[sP] · [LR]([5meC])[sP] · [LR](T) |
| SEQ ID 14 | [LR](T)[sP] · [dR](C)[sP] · [LR](A)[sP] · [dR](C)[sP] · [LR](T)[sP] · [dR](C)[sP] · [LR](T)[sP] · [dR](C)[sP] · [dR](C)[sP] · [LR](T)[sP] · [dR](C)[sP] · [LR]([5meC])[sP] · [dR](C)[sP] · [dR](T)[sP] · [LR](G)[sP] · [LR]([5meC]) |
| SEQ ID 15 | [LR](A)[sP] · [dR](T)[sP] · [dR](C)[sP] · [LR](A)[sP] · [dR](C)[sP] · [LR](T)[sP] · [dR](C)[sP] · [dR](T)[sP] · [LR]([5meC])[sP] · [dR](C)[sP] · [dR](T)[sP] · [LR]([5meC])[sP] · [dR](C)[sP] · [dR](T)[sP] · [LR](T)[sP] · [LR](G) |
| SEQ ID 16 | [LR](A)[sP] · [dR](A)[sP] · [LR](T)[sP] · [dR](C)[sP] · [LR](A)[sP] · [dR](C)[sP] · [LR](T)[sP] · [dR](C)[sP] · [LR](T)[sP] · [dR](C)[sP] · [dR](C)[sP] · [LR](T)[sP] · [dR](C)[sP] · [dR](C)[sP] · [LR]([5meC])[sP] · [LR](T) |
| SEQ ID 17 | [LR](A)[sP] · [dR](A)[sP] · [LR](A)[sP] · [dR](T)[sP] · [dR](C)[sP] · [LR](A)[sP] · [dR](C)[sP] · [LR](T)[sP] · [dR](C)[sP] · [LR](T)[sP] · [dR](C)[sP] · [dR](C)[sP] · [LR](T)[sP] · [dR](C)[sP] · [LR]([5meC])[sP] · [LR]([5meC]) |
| SEQ ID 18 | [LR]([5meC])[sP] · [dR](A)[sP] · [dR](A)[sP] · [LR](A)[sP] · [dR](T)[sP] · [dR](C)[sP] · [LR](A)[sP] · [dR](C)[sP] · [LR](T)[sP] · [dR](C)[sP] · [dR](T)[sP] · [LR]([5meC])[sP] · [dR](C)[sP] · [dR](T)[sP] · [LR]([5meC])[sP] · [LR]([5meC]) |
| SEQ ID 19 | [LR](T)[sP] · [dR](C)[sP] · [LR](A)[sP] · [dR](A)[sP] · [LR](A)[sP] · [dR](T)[sP] · [dR](C)[sP] · [LR](A)[sP] · [dR](C)[sP] · [LR](T)[sP] · [dR](C)[sP] · [LR](T)[sP] · [dR](C)[sP] · [dR](C)[sP] · [LR](T)[sP] · [LR]([5meC]) |
| SEQ ID 20 | [LR]([5meC])[sP] · [dR](T)[sP] · [dR](C)[sP] · [LR](A)[sP] · [dR](A)[sP] · [LR](A)[sP] · [dR](T)[sP] · [dR](C)[sP] · [LR](A)[sP] · [dR](C)[sP] · [LR](T)[sP] · [dR](C)[sP] · [LR]([5meC])[sP] · [dR](T)[sP] · [dR](C)[sP] · [LR]([5meC])[sP] · [LR](T) |
| SEQ ID 21 | [LR](A)[sP] · [dR](C)[sP] · [LR](T)[sP] · [dR](C)[sP] · [LR](A)[sP] · [dR](A)[sP] · [LR](A)[sP] · [dR](T)[sP] · [dR](C)[sP] · [LR](A)[sP] · [dR](C)[sP] · [LR](T)[sP] · [dR](C)[sP] · [dR](T)[sP] · [LR([5meC])[sP] · [LR]([5meC]) |
| SEQ ID 22 | [LR](T)[sP] · [dR](A)[sP] · [dR](C)[sP] · [LR](T)[sP] · [dR](C)[sP] · [LR](A)[sP] · [dR](A)[sP] · [LR](A)[sP] · [dR](T)[sP] · [dR](C)[sP] · [LR](A)[sP] · [dR](C)[sP] · [LR](T)[sP] · [dR](C)[sP] · [dR](C)[sP] · [LR]([5meC]) |
| SEQ ID 23 | [LR]([5meC])[sP] · [dR](T)[sP] · [LR](A)[sP] · [dR](C)[sP] · [LR](T)[sP] · [dR](C)[sP] · [LR](A)[sP] · [dR](A)[sP] · [LR](A)[sP] · [dR](T)[sP] · [dR](C)[sP] · [LR](A)[sP] · [dR](C)[sP] · [dR](T)[sP] · [LR]([5meC])[sP] · [LR](T) |
| SEQ ID 24 | [LR](T)[sP] · [dR](C)[sP] · [dR](T)[sP] · [LR](A)[sP] · [dR](C)[sP] · [LR](T)[sP] · [dR](C)[sP] · [LR](A)[sP] · [dR](A)[sP] · [dR](A)[sP] · [LR](T)[sP] · [dR](C)[sP] · [LR](A)[sP] · [dR](C)[sP] · [LR](T)[sP] · [LR]([5meC]) |
| SEQ ID 25 | [LR](T)[sP] · [dR](T)[sP] · [dR](C)[sP] · [LR](T)[sP] · [dR](A)[sP] · [dR](C)[sP] · [LR](T)[sP] · [dR](C)[sP] · [LR](A)[sP] · [dR](A)[sP] · [LR](T)[sP] · [dR](C)[sP] · [dR](A)[sP] · [LR]([5meC])[sP] · [LR](T) |
| SEQ ID 26 | [LR](T)[sP] · [dR](T)[sP] · [LR](T)[sP] · [dR](C)[sP] · [dR](T)[sP] · [LR](A)[sP] · [dR](C)[sP] · [LR](T)[sP] · [LR]([5meC])[sP] · [dR](A)[sP] · [LR](A)[sP] · [dR](A)[sP] · [LR](T)[sP] · [dR](C)[sP] · [LR](A)[sP] · [LR]([5meC]) |
| SEQ ID 27 | [LR](T)[sP] · [dR](T)[sP] · [LR](T)[sP] · [dR](T)[sP] · [LR](T)[sP] · [dR](A)[sP] · [dR](C)[sP] · [LR](T)[sP] · [dR](C)[sP] · [LR](A)[sP] · [dR](A)[sP] · [LR](A)[sP] · [dR](T)[sP] · [LR]([5meC])[sP] · [LR](A) |
| SEQ ID 28 | [LR]([5meC])[sP] · [dR](T)[sP] · [LR](T)[sP] · [dR](T)[sP] · [dR](T)[sP] · [LR]([5meC])[sP] · [dR](T)[sP] · [LR](A)[sP] · [dR](C)[sP] · [LR](T)[sP] · [dR](C)[sP] · [LR](A)[sP] · [dR](A)[sP] · [dR](A)[sP] · [LR](T)[sP] · [LR]([5meC]) |

| SEQ ID | HELM, 5' - 3' direction |
| --- | --- |
| SEQ ID 29 | [LR](T)[sP] · [dR](C)[sP] · [LR](T)[sP] · [LR](T)[sP] · [dR](T)[sP] · [LR](T)[sP] · [dR](C)[sP] · [dR](T)[sP] · [LR](A)[sP] · [dR](C)[sP] · [dR](T)[sP] · [LR]([5meC])[sP] · [dR](A)[sP] · [dR](A)[sP] · [LR](A)[sP] · [LR](T) |
| SEQ ID 30 | [LR](T)[sP] · [dR](T)[sP] · [dR](C)[sP] · [LR](T)[sP] · [LR](T)[sP] · [dR](T)[sP] · [dR](T)[sP] · [LR]([5meC])[sP] · [dR](T)[sP] · [LR](A)[sP] · [dR](C)[sP] · [dR](T)[sP] · [LR]([5meC])[sP] · [dR](A)[sP] · [LR](A)[sP] · [LR](A) |
| SEQ ID 31 | [LR](T)[sP] · [dR](T)[sP] · [LR](T)[sP] · [dR](C)[sP] · [dR](T)[sP] · [LR](T)[sP] · [dR](T)[sP] · [LR](T)[sP] · [dR](C)[sP] · [dR](T)[sP] · [LR](A)[sP] · [LR]([5meC])[sP] · [dR](T)[sP] · [dR](C)[sP] · [LR](A)[sP] · [LR](A) |
| SEQ ID 32 | [LR](G)[sP] · [dR](T)[sP] · [dR](T)[sP] · [LR](T)[sP] · [dR](C)[sP] · [dR](T)[sP] · [LR](T)[sP] · [dR](T)[sP] · [LR](T)[sP] · [dR](T)[sP] · [dR](C)[sP] · [dR](T)[sP] · [LR](A)[sP] · [dR](C)[sP] · [LR]([5meC])[sP] · [LR](A) |
| SEQ ID 33 | [LR](T)[sP] · [dR](G)[sP] · [dR](T)[sP] · [LR](T)[sP] · [dR](T)[sP] · [dR](C)[sP] · [LR](T)[sP] · [dR](T)[sP] · [dR](T)[sP] · [LR](T)[sP] · [dR](C)[sP] · [dR](T)[sP] · [LR](A)[sP] · [dR](C)[sP] · [LR](T)[sP] · [LR]([5meC] |
| SEQ ID 34 | [LR](G)[sP] · [dR](T)[sP] · [LR](G)[sP] · [dR](T)[sP] · [dR](T)[sP] · [LR](T)[sP] · [dR](C)[sP] · [dR](T)[sP] · [LR](T)[sP] · [dR](T)[sP] · [LR](T)[sP] · [dR](C)[sP] · [dR](T)[sP] · [LR](A)[sP] · [LR]([5meC])[sP] · [LR](T) |
| SEQ ID 35 | [LR](T)[sP] · [dR](G)[sP] · [dR](T)[sP] · [LR](G)[sP] · [dR](T)[sP] · [dR](T)[sP] · [LR](T)[sP] · [dR](T)[sP] · [LR](T)[sP] · [dR](C)[sP] · [dR](T)[sP] · [LR](T)[sP] · [dR](T)[sP] · [LR](T)[sP] · [dR](C)[sP] · [dR](T)[sP] · [LR](A)[sP] · [LR]([5meC] |
| SEQ ID 36 | [LR]([5meC])[sP] · [dR](T)[sP] · [LR](G)[sP] · [dR](T)[sP] · [LR](G)[sP] · [dR](T)[sP] · [dR](T)[sP] · [LR](T)[sP] · [dR](C)[sP] · [dR](T)[sP] · [LR](T)[sP] · [dR](T)[sP] · [LR](T)[sP] · [dR](C)[sP] · [LR](T)[sP] · [LR](A) |
| SEQ ID 37 | [LR](G)[sP] · [dR](C)[sP] · [dR](T)[sP] · [LR](G)[sP] · [dR](T)[sP] · [LR](G)[sP] · [dR](T)[sP] · [dR](T)[sP] · [LR](T)[sP] · [dR](C)[sP] · [dR](T)[sP] · [LR](T)[sP] · [dR](T)[sP] · [dR](T)[sP] · [LR]([5meC])[sP] · [LR](T) |
| SEQ ID 38 | [LR](T)[sP] · [dR](G)[sP] · [dR](C)[sP] · [LR](T)[sP] · [dR](G)[sP] · [dR](T)[sP] · [LR](G)[sP] · [dR](T)[sP] · [dR](T)[sP] · [LR](T)[sP] · [dR](C)[sP] · [dR](T)[sP] · [LR](T)[sP] · [dR](T)[sP] · [LR](T)[sP] · [LR]([5meC] |
| SEQ ID 39 | [LR](A)[sP] · [dR](T)[sP] · [LR](G)[sP] · [dR](C)[sP] · [dR](T)[sP] · [LR](G)[sP] · [dR](T)[sP] · [LR](G)[sP] · [dR](T)[sP] · [LR](T)[sP] · [dR](T)[sP] · [dR](C)[sP] · [LR](T)[sP] · [dR](T)[sP] · [LR](T)[sP] · [LR](T) |
| SEQ ID 40 | [LR](A)[sP] · [dR](A)[sP] · [dR](T)[sP] · [LR](G)[sP] · [dR](C)[sP] · [dR](T)[sP] · [LR](G)[sP] · [dR](T)[sP] · [LR](G)[sP] · [dR](T)[sP] · [dR](T)[sP] · [LR](T)[sP] · [dR](C)[sP] · [dR](T)[sP] · [LR](T)[sP] · [LR](T) |
| SEQ ID 41 | [LR](G)[sP] · [dR](A)[sP] · [LR](A)[sP] · [dR](T)[sP] · [LR](G)[sP] · [dR](C)[sP] · [dR](T)[sP] · [LR](G)[sP] · [dR](T)[sP] · [LR](G)[sP] · [dR](T)[sP] · [LR](T)[sP] · [dR](T)[sP] · [dR](C)[sP] · [LR](T)[sP] · [LR](T) |
| SEQ ID 42 | [LR](G)[sP] · [dR](G)[sP] · [dR](A)[sP] · [LR](A)[sP] · [dR](T)[sP] · [LR](G)[sP] · [dR](C)[sP] · [dR](T)[sP] · [LR](G)[sP] · [dR](T)[sP] · [LR](G)[sP] · [dR](T)[sP] · [LR](T)[sP] · [dR](T)[sP] · [LR]([5meC])[sP] · [LR](T) |
| SEQ ID 43 | [LR](T)[sP] · [dR](G)[sP] · [dR](G)[sP] · [LR](A)[sP] · [dR](A)[sP] · [dR](T)[sP] · [LR](G)[sP] · [dR](C)[sP] · [dR](T)[sP] · [LR](G)[sP] · [dR](T)[sP] · [dR](G)[sP] · [LR](T)[sP] · [dR](T)[sP] · [LR](T)[sP] · [LR]([5meC] |
| SEQ ID 44 | [LR]([5meC])[sP] · [dR](T)[sP] · [dR](G)[sP] · [LR](G)[sP] · [dR](A)[sP] · [LR](A)[sP] · [dR](T)[sP] · [LR](G)[sP] · [dR](C)[sP] · [dR](T)[sP] · [LR](G)[sP] · [dR](T)[sP] · [LR](G)[sP] · [dR](T)[sP] · [LR](T)[sP] · [LR](T) |
| SEQ ID 45 | [LR]([5meC])[sP] · [dR](C)[sP] · [dR](T)[sP] · [LR](G)[sP] · [dR](G)[sP] · [dR](A)[sP] · [LR](A)[sP] · [dR](T)[sP] · [LR](G)[sP] · [dR](C)[sP] · [dR](T)[sP] · [LR](G)[sP] · [dR](T)[sP] · [dR](G)[sP] · [LR](T)[sP] · [LR](T) |
| SEQ ID 46 | [LR](G)[sP] · [dR](C)[sP] · [dR](C)[sP] · [LR](T)[sP] · [dR](G)[sP] · [dR](G)[sP] · [LR](A)[sP] · [dR](A)[sP] · [dR](T)[sP] · [LR](G)[sP] · [dR](C)[sP] · [dR](T)[sP] · [LR](G)[sP] · [dR](T)[sP] · [LR](G)[sP] · [LR](T) |
| SEQ ID 47 | [LR](A)[sP] · [dR](G)[sP] · [dR](C)[sP] · [LR]([5meC])[sP] · [dR](T)[sP] · [dR](G)[sP] · [LR](G)[sP] · [dR](A)[sP] · [LR](A)[sP] · [dR](T)[sP] · [dR](G)[sP] · [LR]([5meC])[sP] · [dR](T)[sP] · [dR](G)[sP] · [LR](T)[sP] · [LR](G) |
| SEQ ID 48 | [LR]([5meC])[sP] · [dR](A)[sP] · [dR](G)[sP] · [LR]([5meC])[sP] · [dR](C)[sP] · [dR](T)[sP] · [LR](G)[sP] · [dR](G)[sP] · [dR](A)[sP] · [LR](A)[sP] · [dR](T)[sP] · [LR](G)[sP] · [dR](C)[sP] · [dR](T)[sP] · [LR](G)[sP] · [LR](T) |
| SEQ ID 49 | [LR]([5meC])[sP] · [dR](C)[sP] · [dR](A)[sP] · [LR](G)[sP] · [dR](C)[sP] · [dR](C)[sP] · [LR](T)[sP] · [dR](G)[P] · [dR](G)[sP] · [LR](A)[sP] · [dR](A)[sP] · [dR](T)[sP] · [LR](G)[sP] · [dR](C)[sP] · [LR](T)[sP] · [LR](G) |
| SEQ ID 50 | [LR](G)[sP] · [dR](C)[sP] · [dR](C)[sP] · [LR](A)[sP] · [dR](G)[sP] · [dR](C)[sP] · [LR]([5meC])[sP] · [dR](T)[sP] · [dR](G)[sP] · [LR](G)[sP] · [dR](A)[sP] · [LR](A)[sP] · [dR](T)[sP] · [dR](G)[sP] · [LR]([5meC])[sP] · [LR](T) |
| SEQ ID 51 | [LR](G)[sP] · [dR](G)[sP] · [dR](C)[sP] · [LR]([5meC])[sP] · [dR](A)[sP] · [dR](G)[sP] · [LR]([5meC])[sP] · [dR](C)[sP] · [dR](T)[sP] · [LR](G)[sP] · [dR](G)[sP] · [dR](A)[sP] · [LR](A)[sP] · [dR](T)[sP] · [LR](G)[sP] · [LR]([5meC] |
| SEQ ID 52 | [LR](G)[sP] · [dR](G)[sP] · [LR](G)[sP] · [dR](C)[sP] · [LR]([5meC])[sP] · [dR](A)[sP] · [dR](G)[sP] · [dR](C)[sP] · [dR](C)[sP] · [LR](T)[sP] · [dR](G)[sP] · [dR](G)[sP] · [LR](G)[sP] · [dR](A)[sP] · [dR](A)[sP] · [LR](T)[sP] · [LR](G) |
| SEQ ID 53 | [LR](G)[sP] · [dR](G)[sP] · [dR](G)[sP] · [LR](G)[sP] · [dR](C)[sP] · [dR](C)[sP] · [LR](A)[sP] · [dR](G)[sP] · [dR](C)[sP] · [LR]([5meC])[sP] · [dR](T)[sP] · [dR](G)[sP] · [LR](G)[sP] · [dR](A)[sP] · [LR](A)[sP] · [LR](T) |

| SEQ ID | HELM, 5' - 3' direction |
|---|---|
| SEQ ID 54 | [LR](T)[sP] · [dR](G)[sP] · [dR](G)[sP] · [LR](G)[sP] · [dR](G)[P] · [dR](C)[sP] · [LR]([5meC])[sP] · [dR](A)[sP] · [dR](G)[sP] · [LR]([5meC])[sP] · [dR](C)[sP] · [dR](T)[sP] · [LR](G)[sP] · [dR](G)[sP] · [LR](A)[sP] · [LR](A) |
| SEQ ID 55 | [LR](G)[sP] · [dR](T)[sP] · [LR](G)[sP] · [dR](G)[sP] · [dR](G)[sP] · [LR](G)[sP] · [dR](C)[sP] · [dR](C)[sP] · [LR](A)[sP] · [dR](G)[sP] · [dR](C)[sP] · [LR]([5meC])[sP] · [dR](T)[sP] · [dR](G)[sP] · [LR](G)[sP] · [LR](A) |
| SEQ ID 56 | [LR](G)[sP] · [dR](G)[sP] · [dR](T)[sP] · [LR](G)[sP] · [dR](G)[sP] · [dR](G)[sP] · [LR](G)[sP] · [dR](C)[sP] · [dR](C)[sP] · [LR](A)[sP] · [dR](G)[sP] · [dR](C)[sP] · [LR]([5meC])[sP] · [dR](T)[sP] · [LR](G)[sP] · [LR](G) |
| SEQ ID 57 | [LR](A)[sP] · [dR](G)[sP] · [dR](G)[sP] · [LR](T)[sP] · [dR](G)[sP] · [dR](G)[sP] · [LR](G)[sP] · [dR](G)[sP] · [dR](C)[sP] · [LR]([5meC])[sP] · [dR](A)[sP] · [LR](G)[sP] · [dR](C)[sP] · [dR](C)[sP] · [LR](T)[sP] · [LR](G) |
| SEQ ID 58 | [LR](G)[sP] · [dR](A)[sP] · [dR](G)[sP] · [LR](G)[sP] · [dR](T)[sP] · [LR](G)[sP] · [dR](G)[sP] · [dR](G)[sP] · [LR](G)[sP] · [dR](C)[sP] · [dR](C)[sP] · [LR](A)[sP] · [dR](G)[sP] · [dR](C)[sP] · [LR]([5meC])[sP] · [LR](T) |
| SEQ ID 59 | [LR](A)[sP] · [dR](G)[sP] · [dR](A)[sP] · [LR](G)[sP] · [dR](G)[sP] · [dR](T)[sP] · [LR](G)[sP] · [dR](G)[sP] · [dR](G)[sP] · [LR](G)[sP] · [dR](C)[sP] · [dR](C)[sP] · [LR](A)[sP] · [dR](G)[sP] · [LR]([5meC])[sP] · [LR]([5meC]) |
| SEQ ID 60 | [LR](T)[sP] · [dR](A)[sP] · [LR](G)[sP] · [dR](A)[sP] · [dR](G)[sP] · [LR](G)[sP] · [dR](T)[sP] · [LR](G)[sP] · [dR](G)[sP] · [dR](G)[sP] · [dR](C)[sP] · [LR]([5meC])[sP] · [dR](A)[sP] · [LR](G)[sP] · [LR]([5meC]) |
| SEQ ID 61 | [LR](A)[sP] · [dR](T)[sP] · [dR](A)[sP] · [LR](G)[sP] · [dR](A)[sP] · [dR](G)[sP] · [LR](G)[sP] · [dR](T)[sP] · [LR](G)[sP] · [dR](G)[sP] · [dR](G)[sP] · [LR](G)[sP] · [dR](C)[sP] · [dR](C)[sP] · [LR](A)[sP] · [LR](G) |
| SEQ ID 62 | [LR](T)[sP] · [dR](A)[sP] · [dR](T)[sP] · [LR](A)[sP] · [dR](G)[sP] · [dR](A)[sP] · [LR](G)[sP] · [dR](G)[sP] · [dR](T)[sP] · [LR](G)[sP] · [dR](G)[sP] · [dR](G)[sP] · [LR](G)[sP] · [dR](C)[sP] · [LR]([5meC])[sP] · [LR](A) |
| SEQ ID 63 | [LR](A)[sP] · [dR](T)[sP] · [LR](A)[sP] · [dR](T)[sP] · [LR](A)[sP] · [dR](G)[sP] · [dR](A)[sP] · [dR](G)[sP] · [LR](G)[sP] · [dR](T)[sP] · [dR](G)[sP] · [LR](G)[sP] · [dR](G)[sP] · [dR](G)[sP] · [LR]([5meC])[sP] · [LR]([5meC]) |
| SEQ ID 64 | [LR](A)[sP] · [dR](A)[sP] · [dR](T)[sP] · [LR](A)[sP] · [dR](T)[sP] · [dR](A)[sP] · [LR](G)[sP] · [dR](A)[sP] · [dR](G)[sP] · [LR](G)[sP] · [dR](T)[sP] · [LR](G)[sP] · [dR](G)[sP] · [dR](G)[sP] · [LR](G)[sP] · [LR]([5meC] |
| SEQ ID 65 | [LR]([5meC])[sP] · [dR](A)[sP] · [LR](A)[sP] · [dR](T)[sP] · [LR](A)[sP] · [dR](T)[sP] · [dR](A)[sP] · [LR](G)[sP] · [dR](A)[sP] · [dR](G)[sP] · [LR](G)[sP] · [dR](T)[sP] · [LR](G)[sP] · [dR](G)[sP] · [LR](G)[sP] · [LR](G) |
| SEQ ID 66 | [LR](T)[sP] · [dR](C)[sP] · [LR](A)[sP] · [dR](A)[sP] · [dR](T)[sP] · [LR](A)[sP] · [dR](T)[sP] · [dR](A)[sP] · [LR](G)[sP] · [dR](A)[sP] · [dR](G)[sP] · [LR](G)[sP] · [dR](T)[sP] · [dR](G)[sP] · [LR](G)[sP] · [LR](G) |
| SEQ ID 67 | [LR](A)[sP] · [dR](T)[sP] · [dR](C)[sP] · [LR](A)[sP] · [dR](A)[sP] · [dR](T)[sP] · [LR](A)[sP] · [dR](T)[sP] · [dR](A)[sP] · [LR](G)[sP] · [dR](A)[sP] · [dR](G)[sP] · [LR](G)[sP] · [dR](T)[sP] · [LR](G)[sP] · [LR](G) |
| SEQ ID 68 | [LR](T)[sP] · [dR](A)[sP] · [LR](T)[sP] · [dR](C)[sP] · [dR](A)[sP] · [LR](A)[sP] · [dR](T)[sP] · [LR](A)[sP] · [dR](T)[sP] · [LR](A)[sP] · [dR](G)[sP] · [LR](A)[sP] · [dR](G)[sP] · [dR](G)[sP] · [LR](T)[sP] · [LR](G) |
| SEQ ID 69 | [LR](T)[sP] · [dR](T)[sP] · [dR](A)[sP] · [LR](T)[sP] · [dR](C)[sP] · [LR](A)[sP] · [LR](A)[sP] · [dR](T)[sP] · [dR](A)[sP] · [LR](T)[sP] · [dR](A)[sP] · [LR](G)[sP] · [dR](A)[sP] · [dR](G)[sP] · [LR](G)[sP] · [LR](T) |
| SEQ ID 70 | [LR]([5meC])[sP] · [LR](T)[sP] · [dR](T)[sP] · [LR](A)[sP] · [dR](T)[sP] · [dR](C)[sP] · [LR](A)[sP] · [dR](A)[sP] · [dR](T)[sP] · [LR](A)[sP] · [dR](T)[sP] · [dR](A)[sP] · [LR](G)[sP] · [dR](A)[sP] · [LR](G)[sP] · [LR](G) |
| SEQ ID 71 | [LR](A)[sP] · [LR]([5meC])[sP] · [dR](T)[sP] · [dR](T)[sP] · [LR](A)[sP] · [dR](T)[sP] · [dR](C)[sP] · [LR](A)[sP] · [LR](A)[sP] · [dR](T)[sP] · [LR](A)[sP] · [dR](T)[sP] · [LR](A)[sP] · [LR](G) |
| SEQ ID 72 | [LR](T)[sP] · [dR](A)[sP] · [dR](C)[sP] · [LR](T)[sP] · [dR](T)[sP] · [LR](A)[sP] · [LR](T)[sP] · [dR](C)[sP] · [LR](A)[sP] · [dR](A)[sP] · [dR](T)[sP] · [LR](A)[sP] · [LR](T)[sP] · [dR](A)[sP] · [LR](G)[sP] · [LR](A) |
| SEQ ID 73 | [LR]([5meC])[sP] · [LR](T)[sP] · [LR](A)[P] · [dR](C)[sP] · [LR](T)[sP] · [dR](T)[sP] · [dR](A)[sP] · [LR](T)[sP] · [dR](C)[sP] · [LR](A)[sP] · [dR](A)[sP] · [dR](T)[sP] · [LR](A)[sP] · [dR](T)[sP] · [LR](G) |
| SEQ ID 74 | [LR](G)[sP] · [dR](C)[sP] · [dR](T)[sP] · [LR](A)[sP] · [dR](C)[sP] · [dR](T)[sP] · [LR](T)[sP] · [dR](A)[sP] · [LR](T)[sP] · [dR](C)[sP] · [LR](A)[sP] · [dR](A)[sP] · [LR](T)[sP] · [dR](A)[sP] · [LR](T)[sP] · [LR](A) |
| SEQ ID 75 | [LR](G)[sP] · [dR](G)[sP] · [dR](C)[sP] · [LR](T)[sP] · [dR](A)[sP] · [dR](C)[sP] · [LR](T)[sP] · [dR](T)[sP] · [LR](A)[sP] · [dR](T)[sP] · [dR](C)[sP] · [LR](A)[sP] · [dR](A)[sP] · [dR](T)[sP] · [LR](A)[sP] · [LR](T) |
| SEQ ID 76 | [LR](T)[sP] · [dR](G)[sP] · [LR](G)[sP] · [dR](C)[sP] · [dR](T)[sP] · [LR](A)[sP] · [dR](C)[sP] · [LR](T)[sP] · [dR](T)[sP] · [LR](A)[sP] · [dR](T)[sP] · [dR](C)[sP] · [LR](A)[sP] · [dR](A)[sP] · [LR](T)[sP] · [LR](A) |
| SEQ ID 77 | [LR](T)[sP] · [dR](T)[sP] · [dR](G)[sP] · [LR](G)[sP] · [dR](C)[sP] · [dR](T)[sP] · [LR](A)[sP] · [dR](C)[sP] · [LR](T)[sP] · [dR](T)[sP] · [LR](A)[sP] · [dR](T)[sP] · [dR](C)[sP] · [dR](A)[sP] · [LR](A)[sP] · [LR](T) |
| SEQ ID 78 | [LR](A)[sP] · [dR](T)[sP] · [dR](T)[sP] · [LR](G)[sP] · [dR](G)[sP] · [dR](C)[sP] · [LR](T)[sP] · [dR](A)[sP] · [dR](C)[sP] · [LR](T)[sP] · [dR](T)[sP] · [LR](A)[sP] · [dR](T)[sP] · [dR](C)[sP] · [LR](A)[sP] · [LR](A) |

-continued

| SEQ ID | HELM, 5' - 3' direction |
|---|---|
| SEQ ID 79 | [LR]([5meC])[sP] · [dR](A)[sP] · [LR](T)[sP] · [dR](T)[sP] · [dR](G)[P] · [LR](G)[sP] · [dR](C)[sP] · [dR](T)[sP] · [LR](A)[sP] · [dR](C)[sP] · [LR](T)[sP] · [dR](T)[sP] · [LR](A)[sP] · [dR](T)[sP] · [LR]([5meC])[sP] · [LR](A) |
| SEQ ID 80 | [LR]([5meC])[sP] · [dR](C)[sP] · [dR](A)[sP] · [LR](T)[sP] · [dR](T)[sP] · [dR](G)[sP] · [LR](G)[sP] · [dR](C)[sP] · [dR](T)[sP] · [LR](A)[sP] · [dR](C)[sP] · [LR](T)[sP] · [dR](T)[sP] · [dR](A)[sP] · [LR](T)[sP] · [LR]([5meC] |
| SEQ ID 81 | [LR]([5meC])[sP] · [dR](C)[sP] · [dR](C)[sP] · [LR](A)[sP] · [dR](T)[sP] · [dR](T)[sP] · [LR](G)[sP] · [dR](G)[sP] · [dR](C)[sP] · [LR](T)[sP] · [dR](A)[sP] · [dR](C)[sP] · [LR](T)[sP] · [dR](T)[sP] · [LR](A)[sP] · [LR](T) |
| SEQ ID 82 | [LR](T)[sP] · [dR](C)[sP] · [dR](C)[sP] · [LR]([5meC])[sP] · [dR](A)[sP] · [LR](T)[sP] · [dR](T)[sP] · [dR](G)[sP] · [LR](G)[sP] · [dR](C)[sP] · [dR](T)[sP] · [LR](A)[sP] · [dR](C)[sP] · [dR](T)[sP] · [LR](T)[sP] · [LR](A) |
| SEQ ID 83 | [LR]([5meC])[sP] · [dR](T)[sP] · [dR](C)[sP] · [LR]([5meC])[sP] · [dR](C)[sP] · [dR](A)[sP] · [LR](T)[sP] · [dR](T)[sP] · [dR](G)[sP] · [LR](G)[sP] · [dR](C)[sP] · [dR](T)[sP] · [LR](A)[sP] · [dR](C)[sP] · [LR](T)[sP] · [LR](T) |
| SEQ ID 84 | [LR](G)[sP] · [dR](C)[sP] · [dR](T)[sP] · [LR]([5meC])[sP] · [dR](C)[sP] · [dR](C)[sP] · [LR](A)[sP] · [dR](T)[sP] · [dR](T)[sP] · [LR](G)[sP] · [dR](G)[sP] · [dR](C)[sP] · [LR](T)[sP] · [dR](A)[sP] · [LR]([5meC])[sP] · [LR](T) |
| SEQ ID 85 | [LR]([5meC])[sP] · [dR](G)[sP] · [dR](C)[sP] · [LR](T)[sP] · [dR](C)[sP] · [dR](C)[sP] · [LR]([5meC])[sP] · [dR](A)[sP] · [LR](T)[sP] · [dR](T)[sP] · [dR](G)[sP] · [LR](G)[sP] · [dR](C)[sP] · [dR](T)[sP] · [LR](A)[sP] · [LR]([5meC] |
| SEQ ID 86 | [LR]([5meC])[sP] · [dR](C)[sP] · [LR](G)[sP] · [dR](C)[sP] · [dR](T)[sP] · [LR]([5meC])[sP] · [dR](C)[sP] · [dR](C)[sP] · [LR](A)[sP] · [dR](T)[sP] · [dR](T)[sP] · [LR](G)[sP] · [dR](G)[sP] · [dR](C)[sP] · [LR](T)[sP] · [LR](A) |
| SEQ ID 87 | [LR]([5meC])[sP] · [dR](C)[sP] · [dR](C)[sP] · [LR](G)[sP] · [dR](C)[sP] · [dR](T)[sP] · [LR]([5meC])[sP] · [dR](C)[sP] · [dR](C)[sP] · [LR](A)[sP] · [dR](T)[sP] · [LR](T)[sP] · [dR](G)[sP] · [dR](G)[sP] · [LR]([5meC]) · [LR](T) |
| SEQ ID 88 | [LR](A)[sP] · [dR](C)[sP] · [dR](C)[sP] · [LR]([5meC])[sP] · [dR](G)[sP] · [dR](C)[sP] · [LR](T)[sP] · [dR](C)[sP] · [dR](C)[sP] · [LR]([5meC])[sP] · [dR](A)[sP] · [LR](T)[sP] · [dR](T)[sP] · [dR](G)[sP] · [LR](G)[sP] · [LR]([5meC]) |
| SEQ ID 89 | [LR](T)[sP] · [dR](A)[sP] · [dR](C)[sP] · [LR]([5meC])[sP] · [dR](C)[sP] · [LR](G)[sP] · [dR](C)[sP] · [dR](T)[sP] · [LR]([5meC])[sP] · [dR](C)[sP] · [dR](C)[sP] · [LR](A)[sP] · [dR](T)[sP] · [dR](T)[sP] · [LR](G)[sP] · [LR](G) |
| SEQ ID 90 | [LR]([5meC])[sP] · [dR](T)[sP] · [dR](A)[sP] · [LR]([5meC])[sP] · [dR](C)[sP] · [dR](C)[sP] · [LR](G)[sP] · [dR](C)[sP] · [dR](T)[sP] · [LR]([5meC]) · [dR](C)[sP] · [dR](C)[sP] · [LR](A)[sP] · [dR](T)[sP] · [LR](T)[sP] · [LR](G) |
| SEQ ID 91 | [LR](G)[sP] · [dR](C)[sP] · [dR](T)[sP] · [LR](A)[sP] · [dR](C)[sP] · [dR](C)[sP] · [LR]([5meC])[sP] · [dR](G)[sP] · [dR](C)[sP] · [LR](T)[sP] · [dR](C)[sP] · [dR](C)[sP] · [LR]([5meC])[sP] · [dR](A)[sP] · [LR](T)[sP] · [LR](T) |
| SEQ ID 92 | [LR](G)[sP] · [dR](G)[sP] · [dR](C)[sP] · [LR](T)[sP] · [dR](A)[sP] · [dR](C)[sP] · [LR]([5meC])[sP] · [dR](C)[sP] · [LR](G)[sP] · [dR](C)[sP] · [dR](T)[sP] · [LR]([5meC])[sP] · [dR](C)[sP] · [dR](A)[sP] · [LR](T) |
| SEQ ID 93 | [LR](G)[sP] · [dR](G)[sP] · [LR](G)[sP] · [dR](C)[sP] · [dR](T)[sP] · [LR](A)[sP] · [dR](C)[sP] · [dR](C)[sP] · [LR]([5meC])[sP] · [dR](G)[sP] · [dR](C)[sP] · [LR](T)[sP] · [dR](C)[sP] · [dR](C)[sP] · [LR]([5meC])[sP] · [LR](A) |
| SEQ ID 94 | [LR](A)[sP] · [dR](G)[sP] · [dR](G)[sP] · [LR](G)[sP] · [dR](C)[sP] · [dR](T)[sP] · [LR](A)[sP] · [dR](C)[sP] · [dR](C)[sP] · [LR]([5meC])[sP] · [dR](G)[sP] · [dR](C)[sP] · [LR](T)[sP] · [dR](C)[sP] · [LR]([5meC])[sP] · [LR]([5meC] |
| SEQ ID 95 | [LR]([5meC])[sP] · [dR](A)[sP] · [dR](G)[sP] · [LR](G)[sP] · [dR](G)[sP] · [dR](C)[sP] · [LR](T)[sP] · [dR](A)[sP] · [dR](C)[sP] · [LR]([5meC])[sP] · [dR](C)[sP] · [LR](G)[sP] · [dR](C)[sP] · [dR](T)[sP] · [LR]([5meC])[sP] · [LR]([5meC] |
| SEQ ID 96 | [LR](T)[sP] · [dR](C)[sP] · [LR](A)[sP] · [dR](G)[sP] · [dR](G)[sP] · [LR](G)[sP] · [dR](C)[sP] · [dR](T)[sP] · [LR](A)[sP] · [dR](C)[sP] · [dR](C)[sP] · [LR]([5meC])[sP] · [dR](G)[sP] · [dR](C)[sP] · [LR](T)[sP] · [LR]([5meC] |
| SEQ ID 97 | [LR](A)[sP] · [dR](T)[sP] · [dR](C)[sP] · [LR](A)[sP] · [dR](G)[sP] · [dR](G)[sP] · [LR](G)[sP] · [dR](C)[sP] · [dR](T)[sP] · [LR](A)[sP] · [dR](C)[sP] · [dR](C)[sP] · [LR]([5meC])[sP] · [dR](G)[sP] · [LR]([5meC])[sP] · [LR](T) |
| SEQ ID 98 | [LR](G)[sP] · [dR](A)[sP] · [LR](T)[sP] · [dR](C)[sP] · [LR](A)[sP] · [dR](G)[sP] · [dR](G)[sP] · [LR](G)[sP] · [dR](G)[sP] · [dR](C)[sP] · [dR](T)[sP] · [LR](A)[sP] · [dR](C)[sP] · [LR]([5meC])[sP] · [LR](G)[sP] · [LR]([5meC] |
| SEQ ID 99 | [LR](G)[sP] · [dR](G)[sP] · [LR](A)[sP] · [dR](T)[sP] · [dR](C)[sP] · [LR](A)[sP] · [dR](G)[sP] · [dR](G)[sP] · [LR](G)[sP] · [dR](C)[sP] · [dR](T)[sP] · [LR](A)[sP] · [dR](C)[sP] · [dR](C)[sP] · [LR]([5meC])[sP] · [LR](G) |
| SEQ ID 100 | [LR](G)[sP] · [dR](G)[sP] · [dR](G)[sP] · [LR](A)[sP] · [dR](T)[sP] · [dR](C)[sP] · [LR](A)[sP] · [dR](G)[sP] · [dR](G)[sP] · [LR](G)[sP] · [dR](C)[sP] · [dR](T)[sP] · [LR](A)[sP] · [dR](C)[sP] · [LR]([5meC])[sP] · [LR]([5meC] |
| SEQ ID 101 | [LR](A)[sP] · [dR](G)[sP] · [dR](G)[sP] · [LR](G)[sP] · [dR](A)[sP] · [LR](T)[sP] · [dR](C)[sP] · [LR](A)[sP] · [dR](G)[sP] · [LR](G)[sP] · [dR](C)[sP] · [dR](T)[sP] · [LR](A)[sP] · [LR]([5meC])[sP] · [LR]([5meC] |
| SEQ ID 102 | [LR]([5meC])[sP] · [dR](A)[sP] · [LR](G)[sP] · [dR](G)[sP] · [LR](A)[sP] · [dR](T)[sP] · [dR](C)[sP] · [LR](A)[sP] · [dR](G)[sP] · [dR](G)[sP] · [LR](G)[sP] · [dR](C)[sP] · [dR](T)[sP] · [LR](A)[sP] · [LR]([5meC] |
| SEQ ID 103 | [LR]([5meC])[sP] · [dR](C)[sP] · [LR](A)[sP] · [dR](G)[sP] · [dR](G)[sP] · [LR](G)[sP] · [dR](A)[sP] · [LR](T)[sP] · [dR](C)[sP] · [LR](A)[sP] · [dR](G)[sP] · [dR](G)[sP] · [LR](G)[sP] · [dR](C)[sP] · [LR](T)[sP] · [LR](A) |

-continued

| SEQ ID | HELM, 5' - 3' direction |
|---|---|
| SEQ ID 104 | [LR](G)[sP] · [dR](C)[sP] · [dR](C)[sP] · [LR](A)[sP] · [dR](G)[sP] · [dR](G)[sP] · [LR](G)[sP] · [dR](A)[sP] · [LR](T)[sP] · [dR](C)[sP] · [dR](A)[sP] · [LR](G)[sP] · [dR](G)[sP] · [dR](G)[sP] · [LR]([5meC])[sP] · [LR](T) |
| SEQ ID 105 | [LR](G)[sP] · [dR](G)[sP] · [dR](C)[sP] · [LR]([5meC])[sP] · [dR](A)[sP] · [LR](G)[sP] · [dR](G)[sP] · [dR](G)[sP] · [LR](A)[sP] · [dR](T)[sP] · [dR](C)[sP] · [LR](A)[sP] · [dR](G)[sP] · [dR](G)[sP] · [LR](G)[sP] · [LR]([5meC] |
| SEQ ID 106 | [LR](T)[sP] · [dR](G)[sP] · [LR](G)[sP] · [dR](C)[sP] · [dR](C)[sP] · [LR](A)[sP] · [dR](G)[sP] · [dR](G)[sP] · [LR](G)[sP] · [dR](A)[sP] · [dR](T)[sP] · [LR]([5meC])[sP] · [dR](A)[sP] · [dR](G)[sP] · [LR](G)[sP] · [LR](G) |
| SEQ ID 107 | [LR](T)[sP] · [dR](T)[sP] · [dR](G)[sP] · [LR](G)[sP] · [dR](C)[sP] · [dR](C)[sP] · [LR](A)[sP] · [dR](G)[sP] · [dR](G)[sP] · [LR](G)[sP] · [dR](A)[sP] · [LR](T)[sP] · [dR](C)[sP] · [dR](A)[sP] · [LR](G)[sP] · [LR](G) |
| SEQ ID 108 | [LR](A)[sP] · [dR](T)[sP] · [dR](T)[sP] · [LR](G)[sP] · [dR](G)[sP] · [dR](C)[sP] · [LR]([5meC])[sP] · [dR](A)[sP] · [LR](G)[sP] · [dR](G)[sP] · [dR](G)[sP] · [LR](A)[sP] · [dR](T)[sP] · [dR](C)[sP] · [LR](A)[sP] · [LR](G) |
| SEQ ID 109 | [LR]([5meC])[sP] · [dR](A)[sP] · [LR](T)[sP] · [dR](T)[sP] · [dR](G)[sP] · [LR](G)[sP] · [dR](C)[sP] · [dR](C)[sP] · [LR](A)[sP] · [dR](G)[sP] · [dR](G)[sP] · [LR](G)[sP] · [dR](A)[sP] · [dR](T)[sP] · [LR]([5meC])[sP] · [LR](A) |
| SEQ ID 110 | [LR]([5meC])[sP] · [dR](C)[sP] · [dR](A)[sP] · [LR](T)[sP] · [dR](T)[sP] · [dR](G)[sP] · [LR](G)[sP] · [dR](C)[sP] · [LR](A)[sP] · [dR](G)[sP] · [dR](G)[sP] · [dR](G)[sP] · [LR](G)[sP] · [dR](A)[sP] · [LR](T)[sP] · [LR]([5meC] |
| SEQ ID 111 | [LR](T)[sP] · [dR](C)[sP] · [dR](C)[sP] · [LR](A)[sP] · [dR](T)[sP] · [dR](T)[sP] · [LR](G)[sP] · [dR](G)[sP] · [dR](C)[sP] · [LR]([5meC])[sP] · [dR](A)[sP] · [LR](G)[sP] · [dR](G)[sP] · [dR](G)[sP] · [LR](A)[sP] · [LR](T) |
| SEQ ID 112 | [LR](T)[sP] · [dR](T)[sP] · [dR](C)[sP] · [LR]([5meC])[sP] · [dR](A)[sP] · [LR](T)[sP] · [dR](T)[sP] · [dR](G)[sP] · [LR](G)[sP] · [dR](C)[sP] · [dR](C)[sP] · [LR](A)[sP] · [dR](G)[sP] · [dR](G)[sP] · [LR](A)[sP] · [LR](A) |
| SEQ ID 113 | [LR](T)[sP] · [dR](T)[sP] · [LR](T)[sP] · [dR](C)[sP] · [dR](C)[sP] · [LR](A)[sP] · [dR](T)[sP] · [dR](T)[sP] · [LR](G)[sP] · [dR](G)[sP] · [dR](C)[sP] · [LR]([5meC])[sP] · [dR](A)[sP] · [dR](G)[sP] · [LR](G)[sP] · [LR](G) |
| SEQ ID 114 | [LR](G)[sP] · [dR](T)[sP] · [dR](T)[sP] · [LR](T)[sP] · [dR](C)[sP] · [dR](C)[sP] · [LR](A)[sP] · [dR](T)[sP] · [dR](T)[sP] · [LR](G)[sP] · [dR](G)[sP] · [dR](C)[sP] · [LR]([5meC])[sP] · [dR](A)[sP] · [LR](G)[sP] · [LR](G) |
| SEQ ID 115 | [LR](A)[sP] · [dR](G)[sP] · [dR](T)[sP] · [LR](T)[sP] · [dR](T)[sP] · [dR](C)[sP] · [LR]([5meC])[sP] · [dR](A)[sP] · [LR](T)[sP] · [dR](T)[sP] · [dR](G)[sP] · [LR](G)[sP] · [dR](C)[sP] · [dR](C)[sP] · [LR](A)[sP] · [LR](G) |
| SEQ ID 116 | [LR]([5meC])[sP] · [dR](A)[sP] · [dR](G)[sP] · [LR](T)[sP] · [dR](T)[sP] · [LR](T)[sP] · [dR](C)[sP] · [dR](C)[sP] · [LR](A)[sP] · [dR](T)[sP] · [dR](G)[sP] · [LR](G)[sP] · [dR](G)[sP] · [LR]([5meC])[sP] · [LR](A |
| SEQ ID 117 | [LR](T)[sP] · [dR](C)[sP] · [dR](A)[sP] · [LR](G)[sP] · [dR](T)[sP] · [dR](T)[sP] · [LR](T)[sP] · [dR](C)[sP] · [dR](C)[sP] · [LR](A)[sP] · [dR](T)[sP] · [LR](T)[sP] · [dR](G)[sP] · [dR](G)[sP] · [LR]([5meC])[sP] · [LR]([5meC] |
| SEQ ID 118 | [LR]([5meC])[sP] · [dR](T)[sP] · [dR](C)[sP] · [LR](A)[sP] · [dR](G)[sP] · [dR](T)[sP] · [LR](T)[sP] · [dR](T)[sP] · [dR](C)[sP] · [LR]([5meC])[sP] · [dR](A)[sP] · [LR](T)[sP] · [dR](T)[sP] · [dR](G)[sP] · [LR](G)[sP] · [LR]([5meC] |
| SEQ ID 119 | [LR]([5meC])[sP] · [dR](C)[sP] · [dR](T)[sP] · [LR]([5meC])[sP] · [dR](A)[sP] · [dR](G)[sP] · [LR](T)[sP] · [dR](T)[sP] · [LR](T)[sP] · [dR](C)[sP] · [dR](C)[sP] · [LR](A)[sP] · [dR](T)[sP] · [dR](T)[sP] · [LR](G)[sP] · [LR](G) |
| SEQ ID 120 | [LR](A)[sP] · [dR](C)[sP] · [dR](C)[sP] · [LR](T)[sP] · [dR](C)[sP] · [dR](A)[sP] · [LR](G)[sP] · [dR](T)[sP] · [dR](T)[sP] · [LR](T)[sP] · [dR](C)[sP] · [dR](C)[sP] · [LR](A)[sP] · [dR](T)[sP] · [LR](T)[sP] · [LR](G) |
| SEQ ID 121 | [LR](T)[sP] · [dR](A)[sP] · [dR](C)[sP] · [LR]([5meC])[sP] · [dR](T)[sP] · [dR](C)[sP] · [LR](A)[sP] · [dR](G)[sP] · [dR](T)[sP] · [LR](T)[sP] · [dR](T)[sP] · [dR](C)[sP] · [LR]([5meC])[sP] · [dR](A)[sP] · [LR](T)[sP] · [LR](T) |
| SEQ ID 122 | [LR]([5meC])[sP] · [dR](T)[sP] · [LR](A)[sP] · [dR](C)[sP] · [dR](C)[sP] · [LR](T)[sP] · [dR](C)[sP] · [dR](A)[sP] · [LR](G)[sP] · [dR](T)[sP] · [dR](T)[sP] · [LR](T)[sP] · [dR](C)[sP] · [dR](C)[sP] · [LR](A)[sP] · [LR](T) |
| SEQ ID 123 | [LR]([5meC])[sP] · [dR](C)[sP] · [dR](T)[sP] · [LR](A)[sP] · [dR](C)[sP] · [dR](C)[sP] · [LR](T)[sP] · [dR](C)[sP] · [LR](A)[sP] · [dR](G)[sP] · [dR](T)[sP] · [LR](T)[sP] · [dR](T)[sP] · [dR](C)[sP] · [LR]([5meC])[sP] · [LR](A) |
| SEQ ID 124 | [LR](G)[sP] · [dR](C)[sP] · [LR]([5meC])[sP] · [dR](T)[sP] · [LR](A)[sP] · [dR](C)[sP] · [dR](C)[sP] · [LR](T)[sP] · [dR](C)[sP] · [LR](A)[sP] · [dR](G)[sP] · [dR](T)[sP] · [LR](T)[sP] · [dR](T)[sP] · [LR]([5meC])[sP] · [LR]([5meC] |
| SEQ ID 125 | [LR]([5meC])[sP] · [dR](G)[sP] · [dR](C)[sP] · [LR]([5meC])[sP] · [dR](T)[sP] · [LR](A)[sP] · [dR](C)[sP] · [dR](C)[sP] · [LR](T)[sP] · [dR](C)[sP] · [dR](A)[sP] · [dR](A)[sP] · [LR](G)[sP] · [dR](T)[sP] · [LR](T)[sP] · [LR]([5meC] |
| SEQ ID 126 | [LR]([5meC])[sP] · [dR]([5meC])[sP] · [dR](G)[sP] · [LR]([5meC])[sP] · [dR](C)[sP] · [dR](T)[sP] · [LR](A)[sP] · [dR](C)[sP] · [dR](C)[sP] · [LR](T)[sP] · [dR](C)[sP] · [LR](A)[sP] · [dR](G)[sP] · [dR](T)[sP] · [LR](T)[sP] · [LR](T) |
| SEQ ID 127 | [LR]([5meC])[sP] · [dR](C)[sP] · [dR](C)[sP] · [LR]([5meC])[sP] · [dR](G)[sP] · [LR]([5meC])[sP] · [dR](T)[sP] · [LR](A)[sP] · [dR](C)[sP] · [dR](C)[sP] · [LR](T)[sP] · [dR](C)[sP] · [LR](A)[sP] · [dR](G)[sP] · [LR](T)[sP] · [LR](T) |
| SEQ ID 128 | [LR](A)[sP] · [dR](C)[sP] · [dR](C)[sP] · [LR]([5meC])[sP] · [dR](G)[sP] · [dR](C)[sP] · [LR]([5meC])[sP] · [dR](T)[sP] · [LR](A)[sP] · [dR](C)[sP] · [dR](C)[sP] · [LR](T)[sP] · [dR](C)[sP] · [dR](A)[sP] · [LR](G)[sP] · [LR](T) |

-continued

| SEQ ID | HELM, 5' - 3' direction |
|---|---|
| SEQ ID 129 | [LR](G)[sP] · [dR](A)[sP] · [dR](C)[sP] · [LR]([5meC])[sP] · [dR]([5meC])[sP] · [dR](G)[sP] · [LR]([5meC])[sP] · [dR](C)[sP] · [dR](T)[sP] · [LR](A)[sP] · [dR](C)[sP] · [dR](C)[sP] · [LR](T)[sP] · [dR](C)[sP] · [LR](A)[sP] · [LR](G) |
| SEQ ID 130 | [LR](T)[sP] · [dR](G)[sP] · [dR](A)[sP] · [LR]([5meC])[sP] · [dR](C)[sP] · [dR](C)[sP] · [LR](G)[sP] · [dR](C)[sP] · [LR]([5meC])[sP] · [dR](T)[sP] · [dR](A)[sP] · [LR]([5meC])[sP] · [dR](C)[sP] · [dR](T)[sP] · [LR]([5meC])[sP] · [LR](A) |
| SEQ ID 131 | [LR](A)[sP] · [dR](T)[sP] · [LR](G)[sP] · [dR](A)[sP] · [dR](C)[sP] · [LR]([5meC])[sP] · [dR]([5meC])[sP] · [dR](G)[sP] · [LR]([5meC])[sP] · [dR](C)[sP] · [dR](T)[sP] · [LR](A)[sP] · [dR](C)[sP] · [dR](C)[sP] · [LR](T)[sP] · [LR]([5meC) |
| SEQ ID 132 | [LR](G)[sP] · [dR](A)[sP] · [dR](T)[sP] · [LR](G)[sP] · [dR](A)[sP] · [dR](C)[sP] · [LR]([5meC])[sP] · [dR]([5meC])[sP] · [dR](G)[sP] · [LR]([5meC])[sP] · [dR](C)[sP] · [dR](T)[sP] · [LR](A)[sP] · [dR](C)[sP] · [LR]([5meC])[sP] · [LR](T) |
| SEQ ID 133 | [LR]([5meC])[sP] · [dR](G)[sP] · [LR](A)[sP] · [dR](T)[sP] · [LR](G)[sP] · [dR](A)[sP] · [dR](C)[sP] · [LR]([5meC])[sP] · [dR](C)[sP] · [LR](G)[sP] · [dR](C)[sP] · [LR]([5meC])[sP] · [dR](T)[sP] · [dR](A)[sP] · [LR]([5meC])[sP] · [LR]([5meC) |
| SEQ ID 134 | [LR](G)[sP] · [dR](C)[sP] · [LR](G)[sP] · [dR](A)[sP] · [LR]([5meC])[sP] · [LR](G)[sP] · [dR](A)[sP] · [dR](C)[sP] · [LR]([5meC])[sP] · [dR]([5meC])[sP] · [dR](G)[sP] · [LR]([5meC])[sP] · [dR](C)[sP] · [dR](T)[sP] · [LR](A)[sP] · [LR]([5meC) |
| SEQ ID 135 | [LR]([5meC])[sP] · [dR](G)[sP] · [dR](C)[sP] · [LR](G)[sP] · [dR](A)[sP] · [dR](T)[sP] · [LR](G)[sP] · [dR](A)[sP] · [dR](C)[sP] · [LR]([5meC])[sP] · [dR](C)[sP] · [LR](G)[sP] · [dR](C)[sP] · [dR](C)[sP] · [LR](T)[sP] · [LR](A) |
| SEQ ID 136 | [LR](G)[sP] · [dR](C)[sP] · [LR](G)[sP] · [dR](C)[sP] · [LR](G)[sP] · [dR](A)[sP] · [dR](T)[sP] · [LR](G)[sP] · [dR](A)[sP] · [dR](C)[sP] · [LR]([5meC])[sP] · [dR](C)[sP] · [dR](C)[sP] · [LR]([5meC])[sP] · [LR](T) |
| SEQ ID 137 | [LR](A)[sP] · [dR](G)[sP] · [dR](C)[sP] · [LR](G)[sP] · [dR](C)[sP] · [LR](G)[sP] · [dR](A)[sP] · [dR](T)[sP] · [LR](G)[sP] · [dR](A)[sP] · [dR](C)[sP] · [LR]([5meC])[sP] · [dR]([5meC])[sP] · [dR](G)[sP] · [LR]([5meC])[sP] · [LR]([5meC) |
| SEQ ID 138 | [LR]([5meC])[sP] · [dR](A)[sP] · [dR](G)[sP] · [LR]([5meC])[sP] · [dR](G)[sP] · [dR](C)[sP] · [LR](G)[sP] · [dR](A)[sP] · [dR](T)[sP] · [LR](G)[sP] · [dR](A)[sP] · [dR](C)[sP] · [LR]([5meC])[sP] · [dR](C)[sP] · [LR](G)[sP] · [LR]([5meC) |
| SEQ ID 139 | [LR]([5meC])[sP] · [dR](C)[sP] · [LR](A)[sP] · [dR](G)[sP] · [dR](C)[sP] · [LR](G)[sP] · [dR]([5meC])[sP] · [dR](G)[sP] · [LR](A)[sP] · [dR](T)[sP] · [dR](G)[sP] · [LR](A)[sP] · [dR](C)[sP] · [dR](C)[sP] · [LR]([5meC])[sP] · [LR](G) |
| SEQ ID 140 | [LR]([5meC])[sP] · [dR](C)[sP] · [dR](C)[sP] · [LR](A)[sP] · [dR](G)[sP] · [dR](C)[sP] · [LR](G)[sP] · [dR](C)[sP] · [LR](G)[sP] · [dR](A)[sP] · [dR](T)[sP] · [LR](G)[sP] · [dR](A)[sP] · [dR](C)[sP] · [LR]([5meC])[sP] · [LR]([5meC) |
| SEQ ID 141 | [LR]([5meC])[sP] · [dR](C)[sP] · [dR](C)[sP] · [LR]([5meC])[sP] · [dR](A)[sP] · [dR](G)[sP] · [LR]([5meC])[sP] · [dR](G)[sP] · [dR](C)[sP] · [LR](G)[sP] · [dR](A)[sP] · [dR](T)[sP] · [LR](G)[sP] · [dR](A)[sP] · [LR]([5meC])[sP] · [LR]([5meC) |
| SEQ ID 142 | [LR](A)[sP] · [dR](C)[sP] · [LR]([5meC])[sP] · [dR](C)[sP] · [dR](C)[sP] · [LR](A)[sP] · [dR](G)[sP] · [dR](C)[sP] · [LR](G)[sP] · [dR]([5meC])[sP] · [dR](G)[sP] · [LR](A)[sP] · [dR](T)[sP] · [dR](G)[sP] · [dR](A)[sP] · [LR]([5meC) |
| SEQ ID 143 | [LR](G)[sP] · [dR](A)[sP] · [dR](C)[sP] · [LR]([5meC])[sP] · [dR](C)[sP] · [dR](C)[sP] · [LR](A)[sP] · [dR](G)[sP] · [dR](C)[sP] · [LR](G)[sP] · [dR](C)[sP] · [LR](G)[sP] · [dR](A)[sP] · [dR](T)[sP] · [LR](G)[sP] · [LR](A) |
| SEQ ID 144 | [LR](A)[sP] · [dR](G)[sP] · [LR](A)[sP] · [dR](C)[sP] · [LR]([5meC])[sP] · [dR](C)[sP] · [dR](C)[sP] · [LR](A)[sP] · [dR](G)[sP] · [dR](C)[sP] · [LR](G)[sP] · [dR](C)[sP] · [LR](G)[sP] · [dR](A)[sP] · [LR](T)[sP] · [LR](G) |
| SEQ ID 145 | [LR]([5meC])[sP] · [dR](A)[sP] · [dR](G)[sP] · [LR](A)[sP] · [dR](C)[sP] · [LR]([5meC])[sP] · [dR](C)[sP] · [LR](A)[sP] · [dR](G)[sP] · [dR](C)[sP] · [LR](G)[sP] · [dR]([5meC])[sP] · [dR](G)[sP] · [LR](C)[sP] · [LR](T) |
| SEQ ID 146 | [LR](A)[sP] · [dR](C)[sP] · [dR](A)[sP] · [LR](G)[sP] · [dR](A)[sP] · [dR](C)[sP] · [LR]([5meC])[sP] · [dR](C)[sP] · [dR](C)[sP] · [LR](A)[sP] · [dR](G)[sP] · [LR](C)[sP] · [LR](G)[sP] · [dR](C)[sP] · [LR](G)[sP] · [LR](A) |
| SEQ ID 147 | [LR](T)[sP] · [dR](A)[sP] · [dR](C)[sP] · [LR](A)[sP] · [dR](G)[sP] · [LR](A)[sP] · [dR](C)[sP] · [dR](C)[sP] · [LR]([5meC])[sP] · [dR](C)[sP] · [dR](A)[sP] · [LR](G)[sP] · [dR]([5meC])[sP] · [dR](G)[sP] · [LR]([5meC])[sP] · [LR](G) |
| SEQ ID 148 | [LR]([5meC])[sP] · [dR](T)[sP] · [LR](A)[sP] · [dR](C)[sP] · [dR](A)[sP] · [LR](G)[sP] · [dR](A)[sP] · [LR](C)[sP] · [LR]([5meC])[sP] · [dR](C)[sP] · [dR](C)[sP] · [LR](A)[sP] · [dR](G)[sP] · [dR](C)[sP] · [LR](G)[sP] · [LR]([5meC) |
| SEQ ID 149 | [LR](A)[sP] · [dR](C)[sP] · [dR](T)[sP] · [LR](A)[sP] · [dR](C)[sP] · [LR](A)[sP] · [dR](G)[sP] · [dR](A)[sP] · [LR]([5meC])[sP] · [dR](C)[sP] · [dR](C)[sP] · [LR]([5meC])[sP] · [dR](A)[sP] · [dR](G)[sP] · [LR]([5meC])[sP] · [LR](G) |
| SEQ ID 150 | [LR](G)[sP] · [dR](A)[sP] · [dR](C)[sP] · [LR](T)[sP] · [dR](A)[sP] · [dR](C)[sP] · [LR](A)[sP] · [dR](G)[sP] · [LR](A)[sP] · [dR](C)[sP] · [dR](C)[sP] · [LR]([5meC])[sP] · [dR](C)[sP] · [dR](A)[sP] · [LR](G)[sP] · [LR]([5meC) |
| SEQ ID 151 | [LR](A)[sP] · [dR](G)[sP] · [LR](A)[sP] · [dR](C)[sP] · [dR](T)[sP] · [LR](A)[sP] · [dR](C)[sP] · [dR](A)[sP] · [LR](G)[sP] · [dR](A)[sP] · [dR](C)[sP] · [LR]([5meC])[sP] · [dR](C)[sP] · [dR](C)[sP] · [LR](A)[sP] · [LR](G) |
| SEQ ID 152 | [LR]([5meC])[sP] · [dR](A)[sP] · [dR](G)[sP] · [LR](A)[sP] · [dR](C)[sP] · [dR](T)[sP] · [LR](A)[sP] · [dR](C)[sP] · [dR](A)[sP] · [LR](G)[sP] · [dR](A)[sP] · [LR]([5meC])[sP] · [dR](C)[sP] · [dR](C)[sP] · [LR]([5meC])[sP] · [LR](A) |
| SEQ ID 153 | [LR](T)[sP] · [dR](C)[sP] · [LR](A)[sP] · [dR](G)[sP] · [LR](A)[sP] · [dR](C)[sP] · [dR](T)[sP] · [LR](A)[sP] · [dR](C)[sP] · [LR](A)[sP] · [dR](G)[sP] · [LR](A)[sP] · [dR](C)[sP] · [dR](C)[sP] · [LR]([5meC])[sP] · [LR]([5meC) |

-continued

| SEQ ID | HELM, 5' - 3' direction |
|---|---|
| SEQ ID 154 | [LR]([5meC])[sP] · [dR](T)[sP] · [dR](C)[sP] · [LR](A)[sP] · [dR](G)[sP] · [LR](A)[sP] · [dR](C)[sP] · [dR](T)[sP] · [LR](A)[sP] · [dR](C)[sP] · [dR](A)[sP] · [LR](G)[sP] · [dR](A)[sP] · [dR](C)[sP] · [LR]([5meC])[sP] · [LR]([5meC] |
| SEQ ID 155 | [LR](G)[sP] · [dR](C)[sP] · [dR](T)[sP] · [LR]([5meC])[sP] · [dR](A)[sP] · [dR](G)[sP] · [LR](A)[sP] · [dR](C)[sP] · [dR](T)[sP] · [LR](A)[sP] · [dR](C)[sP] · [LR](A)[sP] · [dR](G)[sP] · [dR](A)[sP] · [LR]([5meC])[sP] · [LR]([5meC] |
| SEQ ID 156 | [LR]([5meC])[sP] · [dR](G)[sP] · [dR](C)[sP] · [LR](T)[sP] · [dR](C)[sP] · [LR](A)[sP] · [dR](G)[sP] · [LR](A)[sP] · [dR](C)[sP] · [dR](T)[sP] · [LR](A)[sP] · [dR](C)[sP] · [LR](A)[sP] · [dR](G)[sP] · [LR](A)[sP] · [LR]([5meC] |
| SEQ ID 157 | [LR](G)[sP] · [dR](C)[sP] · [LR](G)[sP] · [dR](C)[sP] · [dR](T)[sP] · [LR]([5meC])[sP] · [dR](A)[sP] · [dR](G)[sP] · [LR](A)[sP] · [dR](C)[sP] · A[LR](A)[sP] · [dR](C)[sP] · [dR](A)[sP] · [LR](G)[sP] · [LR](A) |
| SEQ ID 158 | [LR](A)[sP] · [dR](G)[sP] · [dR](C)[sP] · [LR](G)[sP] · [dR](C)[sP] · [dR](T)[sP] · [LR]([5meC])[sP] · [dR](A)[sP] · [dR](G)[sP] · [LR](A)[sP] · [dR](C)[sP] · [dR](T)[sP] · [LR](A)[sP] · [dR](C)[sP] · [LR](A)[P] · [LR](G) |
| SEQ ID 159 | [LR](T)[sP] · [dR](A)[sP] · [dR](G)[sP] · [LR]([5meC])[sP] · [dR](G)[sP] · [dR](C)[sP] · [LR](T)[sP] · [dR](C)[sP] · [LR](A)[sP] · [dR](G)[sP] · [dR](A)[sP] · [LR]([5meC])[sP] · [dR](T)[sP] · [dR](A)[sP] · [LR]([5meC])sP] · [LR](A) |
| SEQ ID 160 | [LR](G)[sP] · [dR](T)[sP] · [LR](A)[sP] · [dR](G)[sP] · [dR](C)[sP] · [LR](G)[sP] · [dR](C)[sP] · [dR](T)[sP] · [LR]([5meC])[sP] · [dR](A)[sP] · [dR](G)[sP] · [LR](A)[sP] · [dR](C)[sP] · [dR](T)[sP] · [LR](A)[sP] · [LR]([5meC] |
| SEQ ID 161 | [LR](G)[sP] · [dR](G)[sP] · [dR](T)[sP] · [LR](A)[sP] · [dR](G)[sP] · [dR](C)[sP] · [LR](G)[sP] · [dR](C)[sP] · [dR](T)[sP] · [LR]([5meC])[sP] · [dR](A)[sP] · [dR](G)[sP] · [LR](A)[sP] · [dR](C)[sP] · [LR](T)[sP] · [LR](A) |
| SEQ ID 162 | [LR](G)[sP] · [dR](G)[sP] · [LR](G)[sP] · [dR](T)[sP] · [LR](A)[sP] · [dR](G)[sP] · [dR](C)[sP] · [LR](G)[sP] · [dR](C)[sP] · [LR](T)[sP] · [dR](C)[sP] · [LR](A)[sP] · [dR](G)[sP] · [dR](A)[sP] · [LR]([5meC])[sP] · [LR](T) |
| SEQ ID 163 | [LR]([5meC])[sP] · [dR](G)[sP] · [dR](G)[sP] · [LR](G)[sP] · [dR](T)[sP] · [LR](A)[sP] · [dR](G)[sP] · [dR](C)[sP] · [LR](G)[sP] · [dR](C)[sP] · [dR](T)[sP] · [LR]([5meC])[sP] · [dR](A)[sP] · [dR](G)[sP] · [LR](A)[sP] · [LR]([5meC] |
| SEQ ID 164 | [LR]([5meC])[sP] · [dR]([5meC])[sP] · [dR](G)[sP] · [LR](G)[sP] · [dR](G)[sP] · [dR](T)[sP] · [LR](A)[sP] · [dR](G)[sP] · [dR](C)[sP] · [LR](G)[sP] · [dR](C)[sP] · [LR](T)[sP] · [dR](C)[sP] · [dR](A)[sP] · [LR](G)[sP] · [LR](A) |
| SEQ ID 165 | [LR](A)[sP] · [dR](C)[sP] · [LR]([5meC])[sP] · [dR](G)[sP] · [dR](G)[sP] · [LR](G)[sP] · [dR](T)[sP] · [LR](A)[sP] · [dR](G)[sP] · [dR](C)[sP] · [LR] [dR](C)[sP] · [LR](T)[sP] · [dR](C)[sP] · [LR](A)[sP] · [LR](G) |
| SEQ ID 166 | [LR](A)[sP] · [dR](A)[sP] · [dR](C)[sP] · [LR]([5meC])[sP] · [dR](G)[sP] · [dR](G)[sP] · [LR](G)[sP] · [dR](T)[sP] · [LR](A)[sP] · [dR](G)[sP] · [dR](C)[sP] · [LR](G)[sP] · [dR](C)[sP] · [dR](T)[sP] · [LR]([5meC])[sP] · [LR](A) |
| SEQ ID 167 | [LR]([5meC])[sP] · [dR](A)[sP] · [LR](A)[P] · [dR](C)[sP] · [LR]([5meC])[sP] · [dR](G)[sP] · [dR](G)[sP] · [LR](G)[sP] · [dR](T)[sP] · [LR](A)[sP] · [dR](G)[sP] · [dR](C)[sP] · [LR](G)[sP] · [dR](C)[sP] · [LR](T)[sP] · [LR]([5meC]) |
| SEQ ID 168 | [LR](G)[sP] · [dR](C)[sP] · [LR](A)[sP] · [dR](A)[sP] · [dR](C)[sP] · [LR]([5meC])[sP] · [dR](G)[sP] · [dR](G)[sP] · [LR](G)[sP] · [dR](T)[sP] · [dR] [LR](G)[sP] · [dR]([5meC])[sP] · [dR](G)[sP] · [LR]([5meC])[sP] · [LR](T) |
| SEQ ID 169 | [LR](A)[sP] · [dR](G)[sP] · [dR](C)[sP] · [LR](A)[sP] · [dR](A)[sP] · [dR](C)[sP] · [LR]([5meC])[sP] · [dR](G)[sP] · [dR](G)[sP] · [LR](G)[sP] · [dR](T)[sP] · [LR](A)[sP] · [dR](G)[sP] · [dR](C)[sP] · [LR](G)[sP] · [LR]([5meC] |
| SEQ ID 170 | [LR]([5meC])[sP] · [dR](A)[sP] · [LR](G)[sP] · [dR](C)[sP] · [LR](A)[sP] · [dR](A)[sP] · [dR](C)[sP] · [LR]([5meC])[sP] · [dR](G)[sP] · [dR](G)[sP] · [LR](G)[sP] · [dR](T)[sP] · [LR](A)[sP] · [dR](G)[sP] · [LR]([5meC])[sP] · [LR](G) |
| SEQ ID 171 | [LR](G)[sP] · [dR](C)[sP] · [LR](A)[sP] · [dR](G)[sP] · [dR](C)[sP] · [LR](A)[sP] · [dR](A)[sP] · [dR](C)[sP] · [LR]([5meC])[sP] · [dR](G)[sP] · [dR](G)[sP] · [LR](G)[sP] · [dR](T)[sP] · [LR](A)[sP] · [dR](A)[sP] · [LR](G)[sP] · [LR]([5meC] |
| SEQ ID 172 | [LR](A)[sP] · [dR](G)[sP] · [dR](C)[sP] · [LR](A)[sP] · [dR](G)[sP] · [dR](C)[sP] · [LR](A)[sP] · [dR](A)[sP] · [dR](C)[sP] · [LR]([5meC])[sP] · [dR](GC)[sP] · [LR](G)[sP] · [dR](T)[sP] · [LR](A)[sP] · [LR](G) |
| SEQ ID 173 | [LR]([5meC])[sP] · [dR](A)[sP] · [LR](G)[sP] · [dR](C)[sP] · [LR](A)[sP] · [dR](G)[sP] · [dR](C)[sP] · [LR](A)[sP] · [LR](A)[sP] · [dR](G)[sP] · [dR](C)[sP] · [LR](C)[sP] · [dR](G)[sP] · [LR](T)[sP] · [LR](A) |
| SEQ ID 174 | [LR](G)[sP] · [dR](C)[sP] · [LR](A)[sP] · [dR](G)[sP] · [dR](C)[sP] · [LR](A)[sP] · [dR](G)[sP] · [dR](C)[sP] · [LR](A)[sP] · [dR](A)[sP] · [dR](C)[sP] · [LR]([5meC])[sP] · [dR](G)[sP] · [dR](G)[sP] · [LR](G)[sP] · [LR](T) |
| SEQ ID 175 | [LR](G)[sP] · [dR](G)[sP] · [dR](C)[sP] · [LR](A)[sP] · [dR](G)[sP] · [dR](C)[sP] · [LR](A)[sP] · [dR](G)[sP] · [LR](A)[sP] · [dR](A)[sP] · [dR](C)[sP] · [LR]([5meC])[sP] · [dR](G)[sP] · [LR](G)[sP] · [LR](G) |
| SEQ ID 176 | [LR](G)[sP] · [dR](G)[sP] · [LR](G)[sP] · [dR](C)[sP] · [LR](A)[sP] · [dR](G)[sP] · [dR](C)[sP] · [LR](A)[sP] · [dR](G)[sP] · [dR](C)[sP] · [LR](A)[sP] · [LR](A)[sP] · [dR](C)[sP] · [LR](C)[sP] · [LR](G)[sP] · [LR](G) |
| SEQ ID 177 | [LR](T)[sP] · [dR](G)[sP] · [dR](G)[sP] · [LR](G)[sP] · [dR](C)[sP] · [LR](A)[sP] · [dR](G)[sP] · [dR](C)[sP] · [LR](A)[sP] · [dR](G)[sP] · [dR](C)[sP] · [LR](A)[sP] · [dR](A)[sP] · [LR]([5meC])[sP] · [LR](G) |
| SEQ ID 178 | [LR](T)[sP] · [dR](T)[sP] · [dR](G)[sP] · [LR](G)[sP] · [dR](G)[sP] · [dR](C)[sP] · [LR](A)[sP] · [dR](G)[sP] · [dR](C)[sP] · [LR](A)[sP] · [dR](G)[sP] · [dR](C)[sP] · [LR](A)[sP] · [dR](A)[sP] · [LR]([5meC])[sP] · [LR]([5meC] |

| SEQ ID | HELM, 5' - 3' direction |
|---|---|
| SEQ ID 179 | [LR]([5meC])[sP] · [dR](T)[sP] · [LR](T)[sP] · [dR](G)[sP] · [dR](G)[sP] · [LR](G)[sP] · [dR](C)[sP] · [LR](A)[sP] · [dR](G)[sP] · [dR](C)[sP] · [LR](A)[sP] · [dR](G)[sP] · [dR](C)[sP] · [LR](A)[sP] · [LR](A)[sP] · [LR]([5meC]) |
| SEQ ID 180 | [LR]([5meC])[sP] · [dR](C)[sP] · [dR](T)[sP] · [LR](T)[sP] · [dR](G)[sP] · [dR](G)[sP] · [LR](G)[sP] · [dR](C)[sP] · [LR](A)[sP] · [dR](G)[sP] · [dR](C)[sP] · [LR](A)[sP] · [dR](G)[sP] · [dR](C)[sP] · [LR](A)[sP] · [LR](A) |
| SEQ ID 181 | [LR](T)[sP] · [dR](C)[sP] · [dR](C)[sP] · [LR](T)[sP] · [dR](T)[sP] · [dR](G)[sP] · [LR](G)[sP] · [dR](G)[sP] · [dR](C)[sP] · [LR](A)[sP] · [dR](G)[sP] · [dR](C)[sP] · [LR](A)[sP] · [dR](G)[sP] · [LR]([5meC])[sP] · [LR](A) |
| SEQ ID 182 | [LR](G)[sP] · [dR](T)[sP] · [LR]([5meC])[sP] · [dR](C)[sP] · [dR](T)[sP] · [LR](T)[sP] · [dR](G)[sP] · [dR](G)[sP] · [LR](G)[sP] · [dR](C)[sP] · [dR](A)[sP] · [LR](G)[sP] · [dR](C)[sP] · [dR](A)[sP] · [LR](G)[sP] · [LR]([5meC] |
| SEQ ID 183 | [LR](G)[sP] · [dR](G)[sP] · [dR](T)[sP] · [LR]([5meC])[sP] · [dR](C)[sP] · [dR](T)[sP] · [LR](T)[sP] · [dR](G)[sP] · [dR](G)[sP] · [LR](G)[sP] · [dR](C)[sP] · [LR](A)[sP] · [dR](G)[sP] · [dR](C)[sP] · [LR](A)[sP] · [LR](G) |
| SEQ ID 184 | [LR]([5meC])[sP] · [dR](G)[sP] · [dR](G)[sP] · [LR](T)[sP] · [dR](C)[sP] · [dR](C)[sP] · [LR](T)[sP] · [dR](T)[sP] · [LR](G)[sP] · [dR](G)[sP] · [dR](G)[sP] · [LR]([5meC])[sP] · [dR](A)[sP] · [dR](G)[sP] · [LR]([5meC])[sP] · [LR](A) |
| SEQ ID 185 | [LR](G)[sP] · [dR](C)[sP] · [LR](G)[sP] · [dR](G)[sP] · [dR](T)[P] · [LR]([5meC])[sP] · [dR](C)[sP] · [dR](T)[sP] · [LR](T)[sP] · [dR](G)[sP] · [dR](G)[sP] · [LR](G)[sP] · [dR](C)[sP] · [dR](A)[sP] · [LR](G)[sP] · [LR]([5meC] |
| SEQ ID 186 | [LR]([5meC])[sP] · [dR](G)[sP] · [dR](C)[sP] · [LR](G)[sP] · [dR](G)[sP] · [dR](T)[sP] · [LR]([5meC])[sP] · [dR](C)[sP] · [dR](T)[sP] · [LR](T)[sP] · [dR](G)[sP] · [dR](G)[sP] · [LR](G)[sP] · [dR](C)[sP] · [LR](A)[sP] · [LR](G) |
| SEQ ID 187 | [LR]([5meC])[sP] · [dR](C)[sP] · [LR](G)[sP] · [dR]([5meC])[sP] · [dR](G)[sP] · [LR](G)[sP] · [dR](T)[sP] · [dR](C)[sP] · [LR]([5meC])[sP] · [dR](T)[sP] · [dR](T)[sP] · [LR](G)[sP] · [dR](G)[sP] · [dR](G)[sP] · [LR]([5meC])[sP] · [LR](A |
| SEQ ID 188 | [LR](T)[sP] · [dR](C)[sP] · [dR](C)[sP] · [LR](G)[sP] · [dR](C)[sP] · [LR](G)[sP] · [dR](G)[sP] · [LR]([5meC])[sP] · [dR](C)[sP] · [dR](T)[sP] · [LR](T)[sP] · [dR](G)[sP] · [dR](G)[sP] · [LR](G)[sP] · [LR]([5meC] |
| SEQ ID 189 | [LR]([5meC])[sP] · [dR](T)[sP] · [dR](C)[sP] · [LR]([5meC])[sP] · [dR](G)[sP] · [dR](C)[sP] · [LR](G)[sP] · [dR](G)[sP] · [LR](T)[sP] · [dR](C)[sP] · [dR](C)[sP] · [LR](T)[sP] · [dR](T)[sP] · [dR](G)[sP] · [LR](G)[sP] · [LR](G) |
| SEQ ID 190 | [LR](A)[sP] · [dR](C)[sP] · [LR](T)[sP] · [dR](C)[sP] · [dR](C)[sP] · [LR](G)[sP] · [dR]([5meC])[sP] · [dR](G)[sP] · [LR](G)[sP] · [dR](T)[sP] · [dR](C)[sP] · [LR]([5meC])[sP] · [dR](T)[sP] · [dR](T)[sP] · [LR](G)[sP] · [LR](G) |
| SEQ ID 191 | [LR](G)[sP] · [dR](A)[sP] · [dR](C)[sP] · [LR](T)[sP] · [dR](C)[sP] · [dR](C)[sP] · [LR](G)[sP] · [dR](C)[sP] · [LR](G)[sP] · [dR](G)[sP] · [dR](T)[sP] · [LR]([5meC])[sP] · [dR](C)[sP] · [dR](T)[sP] · [LR](T)[sP] · [LR](G) |
| SEQ ID 192 | [LR]([5meC])[sP] · [dR](G)[sP] · [LR](A)[sP] · [dR](C)[sP] · [dR](T)[sP] · [LR]([5meC])[sP] · [dR]([5meC])[sP] · [dR](G)[sP] · [LR]([5meC])[sP] · [dR](G)[sP] · [dR](G)[sP] · [LR](T)[sP] · [dR](C)[sP] · [dR](C)[sP] · [LR](T)[sP] · [LR](T) |
| SEQ ID 193 | [LR]([5meC])[sP] · [dR](C)[sP] · [LR](G)[sP] · [dR](A)[sP] · [dR](C)[sP] · [LR](T)[sP] · [dR](C)[sP] · [dR](C)[sP] · [LR](G)[sP] · [dR]([5meC])[sP] · [dR](G)[sP] · [LR](G)[sP] · [dR](T)[sP] · [dR](C)[sP] · [LR]([5meC])[sP] · [LR](T) |
| SEQ ID 194 | [LR](T)[sP] · [dR](C)[sP] · [dR](C)[sP] · [LR](G)[sP] · [dR](A)[sP] · [dR](C)[sP] · [LR](T)[sP] · [dR](C)[sP] · [dR](C)[sP] · [LR](G)[sP] · [dR](C)[sP] · [LR](G)[sP] · [dR](G)[sP] · [dR](T)[sP] · [LR]([5meC])[sP] · [LR](5meC) |
| SEQ ID 195 | [LR](G)[sP] · [dR](T)[sP] · [LR]([5meC])[sP] · [dR](C)[sP] · [LR](G)[sP] · [dR](A)[sP] · [dR](C)[sP] · [LR](T)[sP] · [dR](C)[sP] · [dR](C)[sP] · [LR](G)[sP] · [dR](C)[sP] · [LR](G)[sP] · [dR](G)[sP] · [LR](T)[sP] · [LR]([5meC] |
| SEQ ID 196 | [LR]([5meC])[sP] · [dR](G)[sP] · [LR](T)[sP] · [dR](C)[sP] · [dR](C)[sP] · [LR](G)[sP] · [dR](A)[sP] · [dR](C)[sP] · [LR](T)[sP] · [dR](C)[sP] · [dR](C)[sP] · [LR](G)[sP] · [dR]([5meC])[sP] · [dR](G)[sP] · [LR](G)[sP] · [LR](T) |
| SEQ ID 197 | [LR](G)[sP] · [dR]([5meC])[sP] · [dR](G)[sP] · [LR](T)[sP] · [dR](C)[sP] · [dR](C)[sP] · [LR](G)[sP] · [dR](A)[sP] · [dR](C)[sP] · [LR](T)[sP] · [dR](C)[sP] · [dR](C)[sP] · [LR](G)[sP] · [dR](C)[sP] · [LR](G)[sP] · [LR](G) |
| SEQ ID 198 | [LR](T)[sP] · [dR](G)[sP] · [dR](C)[sP] · [LR](G)[sP] · [dR](T)[sP] · [dR](C)[sP] · [LR]([5meC])[sP] · [dR](G)[sP] · [LR](A)[sP] · [dR](C)[sP] · [dR](T)[sP] · [LR]([5meC])[sP] · [dR]([5meC])[sP] · [dR](G)[sP] · [LR]([5meC])[sP] · [LR](G) |
| SEQ ID 199 | [LR]([5meC])[sP] · [dR](T)[sP] · [LR](G)[sP] · [dR]([5meC])[sP] · [dR](G)[sP] · [LR](T)[sP] · [dR](C)[sP] · [dR](C)[sP] · [LR](G)[sP] · [dR](A)[sP] · [dR](C)[sP] · [LR](T)[sP] · [dR](C)[sP] · [dR](C)[sP] · [LR](G)[sP] · [LR]([5meC] |
| SEQ ID 200 | [LR]([5meC])[sP] · [dR](C)[sP] · [dR](T)[sP] · [LR](G)[sP] · [dR]([5meC])[sP] · [dR](G)[sP] · [LR](T)[sP] · [dR](C)[sP] · [dR](C)[sP] · [LR](G)[sP] · [dR](A)[sP] · [dR](C)[sP] · [LR](T)[sP] · [dR](C)[sP] · [LR]([5meC])[sP] · [LR](G) |
| SEQ ID 201 | [LR](G)[sP] · [dR](C)[sP] · [dR](C)[sP] · [LR](T)[sP] · [dR](G)[sP] · [dR](C)[sP] · [LR](G)[sP] · [dR](T)[sP] · [dR](C)[sP] · [LR]([5meC])[sP] · [dR](G)[sP] · [LR](A)[sP] · [dR](C)[sP] · [dR](T)[sP] · [LR]([5meC])[sP] · [LR]([5meC] |
| SEQ ID 202 | [LR](T)[sP] · [dR](G)[sP] · [dR](C)[sP] · [LR]([5meC])[sP] · [dR](T)[sP] · [LR](G)[sP] · [dR]([5meC])[sP] · [dR](G)[sP] · [LR](T)[sP] · [dR](C)[sP] · [dR](C)[sP] · [LR](G)[sP] · [dR](A)[sP] · [dR](C)[sP] · [LR](T)[sP] · [LR]([5meC] |
| SEQ ID 203 | [LR]([5meC])[sP] · [dR](T)[sP] · [dR](G)[sP] · [LR]([5meC])[sP] · [dR](C)[sP] · [dR](T)[sP] · [LR](G)[sP] · [dR]([5meC])[sP] · [dR](G)[sP] · [LR](T)[sP] · [dR](C)[sP] · [dR](C)[sP] · [LR](G)[sP] · [dR](A)[sP] · [LR]([5meC])[sP] · [LR](T) |

| SEQ ID | HELM, 5' - 3' direction |
|---|---|
| SEQ ID 204 | [LR](T)[sP] · [dR](C)[sP] · [dR](T)[sP] · [LR](G)[sP] · [dR](C)[sP] · [dR](C)[sP] · [LR](T)[sP] · [dR](G)[sP] · [dR](C)[sP] · [LR](G)[sP] · [dR](T)[sP] · [dR](C)[sP] · [LR]([5meC])[sP] · [LR](G)[sP] · [LR](A)[sP] · [LR]([5meC]) |
| SEQ ID 205 | [LR](G)[sP] · [dR](T)[sP] · [dR](C)[sP] · [LR](T)[sP] · [dR](G)[sP] · [dR](C)[sP] · [LR]([5meC])[sP] · [dR](T)[sP] · [LR](G)[sP] · [LR]([5meC])[sP] · [dR](G)[sP] · [LR](T)[sP] · [dR](C)[sP] · [dR](C)[sP] · [LR](G)[sP] · [LR](A) |
| SEQ ID 206 | [LR](G)[sP] · [dR](G)[sP] · [LR](T)[sP] · [dR](C)[sP] · [LR](T)[sP] · [LR](G)[sP] · [dR](C)[sP] · [dR](C)[sP] · [LR](T)[sP] · [dR](G)[sP] · [dR](C)[sP] · [LR](G)[sP] · [dR](T)[sP] · [dR](C)[sP] · [LR]([5meC])[sP] · [LR](G) |
| SEQ ID 207 | [LR](G)[sP] · [dR](C)[sP] · [LR](T)[sP] · [dR](C)[sP] · [dR](C)[sP] · [LR]([5meC])[sP] · [dR](A)[sP] · [LR](T)[sP] · [dR](T)[sP] · [LR](G)[sP] · [LR](G)[sP] · [dR](C)[sP] · [dR](T)[sP] · [LR](A)[sP] · [dR](C)[sP] · [dR](T)[sP] · [LR](T)[sP] · [LR](A) |
| SEQ ID 208 | [LR]([5meC])[sP] · [dR](G)[sP] · [dR](C)[sP] · [LR](T)[sP] · [dR](C)[sP] · [dR](C)[sP] · [LR]([5meC])[sP] · [dR](A)[sP] · [dR](T)[sP] · [dR](T)[sP] · [dR](G)[sP] · [LR](G)[sP] · [dR](C)[sP] · [dR](T)[sP] · [LR](A)[sP] · [dR](C)[sP] · [LR](T)[sP] · [LR](T) |
| SEQ ID 209 | [LR]([5meC])[sP] · [dR](C)[sP] · [LR](G)[sP] · [dR](C)[sP] · [dR](T)[sP] · [LR]([5meC])[sP] · [dR](C)[sP] · [dR](C)[sP] · [LR](A)[sP] · [dR](T)[sP] · [dR](T)[sP] · [LR](G)[sP] · [dR](G)[sP] · [dR](C)[sP] · [dR](T)[sP] · [dR](A)[sP] · [LR]([5meC])[sP] |
| SEQ ID 210 | [LR]([5meC])[sP] · [dR](C)[sP] · [dR](C)[sP] · [LR](G)[sP] · [dR](C)[sP] · [LR](T)[sP] · [dR](C)[sP] · [dR](C)[sP] · [LR]([5meC])[sP] · [dR](A)[sP] · [LR](T)[sP] · [dR](T)[sP] · [dR](G)[sP] · [LR](G)[sP] · [dR](C)[sP] · [dR](T)[sP] · [LR](A)[sP] · [LR]([5meC]) |
| SEQ ID 211 | [LR](A)[sP] · [dR](C)[sP] · [LR]([5meC])[sP] · [dR](C)[sP] · [LR](G)[sP] · [dR](C)[sP] · [dR](T)[sP] · [LR]([5meC])[sP] · [dR](C)[sP] · [dR](C)[sP] · [LR](A)[sP] · [dR](T)[sP] · [dR](T)[sP] · [LR](G)[sP] · [dR](G)[sP] · [dR](C)[sP] · [LR](T)[sP] · [LR](A) |
| SEQ ID 212 | [LR](T)[sP] · [dR](A)[sP] · [dR](C)[sP] · [LR]([5meC])[sP] · [dR](C)[sP] · [LR](G)[sP] · [dR](C)[sP] · [dR](T)[sP] · [LR]([5meC])[sP] · [dR](C)[sP] · [dR](C)[sP] · [LR](A)[sP] · [dR](T)[sP] · [LR](T)[sP] · [dR](G)[sP] · [dR](G)[sP] · [LR]([5meC])[sP] · [LR](T) |
| SEQ ID 213 | [LR]([5meC])[sP] · [dR](T)[sP] · [LR](A)[sP] · [dR]([5meC])[sP] · [dR](C)[sP] · [LR]([5meC])[sP] · [dR](G)[sP] · [dR](C)[sP] · [LR](T)[sP] · [dR](C)[sP] · [LR]([5meC])[sP] · [dR](A)[sP] · [LR](T)[sP] · [dR](T)[sP] · [dR](G)[sP] · [LR](G)[sP] · [LR]([5meC]) |
| SEQ ID 214 | [LR](G)[sP] · [dR](C)[sP] · [dR](T)[sP] · [LR](A)[sP] · [dR](C)[sP] · [LR]([5meC])[sP] · [dR](C)[sP] · [LR](G)[sP] · [dR](C)[sP] · [dR](T)[sP] · [LR]([5meC])[sP] · [dR](C)[sP] · [dR](C)[sP] · [LR](A)[sP] · [dR](T)[sP] · [LR](G)[sP] · [LR](G) |
| SEQ ID 215 | [LR](G)[sP] · [dR](G)[sP] · [dR](C)[sP] · [LR](T)[sP] · [dR](A)[sP] · [dR](C)[sP] · [LR]([5meC])[sP] · [dR](C)[sP] · [LR](G)[sP] · [dR](C)[sP] · [dR](T)[sP] · [LR]([5meC][sP] · [dR](C)[sP] · [dR](C)[sP] · [LR](A)[sP] · [dR](T)[sP] · [LR](T)[sP] · [LR](G) |
| SEQ ID 216 | [LR](G)[sP] · [dR](G)[sP] · [LR](G)[sP] · [dR](C)[sP] · [dR](T)[sP] · [LR](A)[sP] · [dR](C)[sP] · [dR](C)[sP] · [LR]([5meC])[sP] · [dR](G)[sP] · [dR](C)[sP] · [LR](T)[sP] · [dR](C)[sP] · [dR](C)[sP] · [LR]([5meC])[sP] · [dR](A)[sP] · [LR](T)[sP] · [LR](T) |
| SEQ ID 217 | [LR](A)[sP] · [dR](G)[sP] · [dR](G)[sP] · [LR](G)[sP] · [dR](C)[sP] · [dR](T)[sP] · [LR](A)[sP] · [dR](C)[sP] · [LR]([5meC])[sP] · [dR](C)[sP] · [LR](G)[sP] · [dR](C)[sP] · [dR](T)[sP] · [LR]([5meC])[sP] · [dR](C)[sP] · [dR](C)[sP] · [LR](A)[sP] · [LR](T) |
| SEQ ID 218 | [LR]([5meC])[sP] · [dR](A)[sP] · [LR](G)[sP] · [dR](G)[sP] · [LR](G)[sP] · [dR](C)[sP] · [dR](T)[sP] · [LR](A)[sP] · [dR](C)[sP] · [LR]([5meC])[sP] · [dR](G)[sP] · [dR](C)[sP] · [LR](T)[sP] · [dR](C)[sP] · [dR](C)[sP] · [LR]([5meC])[sP] · [LR](A) |
| SEQ ID 219 | [LR](T)[sP] · [dR](C)[sP] · [LR](A)[sP] · [dR](G)[sP] · [dR](G)[sP] · [LR](G)[sP] · [dR](C)[sP] · [dR](T)[sP] · [LR](A)[sP] · [dR](G)[sP] · [dR](C)[sP] · [LR]([5meC])[sP] · [dR](G)[sP] · [dR](C)[sP] · [LR](T)[sP] · [dR](C)[sP] · [LR]([5meC])[sP] · [LR]([5meC]) |
| SEQ ID 220 | [LR](A)[sP] · [dR](T)[sP] · [dR](C)[sP] · [LR](A)[sP] · [dR](G)[sP] · [dR](G)[sP] · [LR](G)[sP] · [dR](C)[sP] · [dR](T)[sP] · [LR](A)[sP] · [dR](C)[sP] · [LR]([5meC])[sP] · [dR](C)[sP] · [LR](G)[sP] · [dR](C)[sP] · [dR](T)[sP] · [LR]([5meC])[sP] · [LR]([5meC] |
| SEQ ID 221 | [LR](G)[sP] · [dR](A)[sP] · [LR](T)[sP] · [dR](C)[sP] · [LR](A)[sP] · [dR](G)[sP] · [dR](G)[sP] · [LR](G)[sP] · [dR](C)[sP] · [dR](T)[sP] · [LR](A)[sP] · [dR](C)[sP] · [dR](C)[sP] · [LR]([5meC])[sP] · [dR](G)[sP] · [dR](C)[sP] · [LR](T)[sP] · [LR]([5meC] |
| SEQ ID 222 | [LR](G)[sP] · [dR](G)[sP] · [LR](A)[sP] · [dR](T)[sP] · [dR](C)[P] · [LR](A)[sP] · [dR](G)[sP] · [dR](G)[sP] · [LR](G)[sP] · [dR](C)[sP] · [dR](T)[sP] · [LR](A)[sP] · [dR](C)[sP] · [dR](C)[sP] · [LR]([5meC])[sP] · [dR](G)[sP] · [LR]([5meC])[sP] · [LR](T) |
| SEQ ID 223 | [LR](G)[sP] · [dR](G)[sP] · [dR](G)[sP] · [LR](A)[sP] · [dR](T)[sP] · [dR](C)[sP] · [LR](A)[sP] · [dR](G)[sP] · [dR](G)[sP] · [LR](G)[sP] · [dR](C)[sP] · [dR](T)[sP] · [LR](A)[sP] · [dR](C)[sP] · [LR]([5meC])[sP] · [dR](C)[sP] · [LR](G)[sP] · [LR]([5meC] |
| SEQ ID 224 | [LR](A)[sP] · [dR](G)[sP] · [dR](G)[sP] · [LR](G)[sP] · [dR](A)[sP] · [LR](T)[sP] · [dR](C)[sP] · [LR](A)[sP] · [dR](G)[sP] · [dR](G)[sP] · [LR](G)[sP] · [dR](C)[sP] · [dR](T)[sP] · [LR](A)[sP] · [dR](C)[sP] · [dR](C)[sP] · [LR]([5meC])[sP] · [LR](G) |
| SEQ ID 225 | [LR]([5meC])[sP] · [dR](A)[sP] · [LR](G)[sP] · [dR](G)[sP] · [dR](G)[sP] · [LR](A)[sP] · [dR](T)[sP] · [dR](C)[sP] · [LR](A)[sP] · [dR](G)[sP] · [dR](G)[sP] · [LR](G)[sP] · [dR](C)[sP] · [dR](T)[sP] · [LR](A)[sP] · [dR](C)[sP] · [LR]([5meC])[sP] · [LR]([5meC] |
| SEQ ID 226 | [LR]([5meC])[sP] · [dR](C)[sP] · [LR](A)[sP] · [dR](G)[sP] · [dR](G)[sP] · [LR](G)[sP] · [dR](A)[sP] · [LR](T)[sP] · [dR](C)[sP] · [LR](A)[sP] · [dR](G)[sP] · [dR](G)[sP] · [LR](G)[sP] · [dR](C)[sP] · [dR](T)[sP] · [LR](A)[sP] · [LR]([5meC])[sP] · [LR]([5meC] |
| SEQ ID 227 | [LR](G)[sP] · [dR](C)[sP] · [dR](C)[sP] · [LR](A)[sP] · [dR](G)[sP] · [dR](G)[sP] · [LR](G)[sP] · [dR](A)[sP] · [LR](T)[sP] · [dR](C)[sP] · [LR](A)[sP] · [dR](G)[sP] · [dR](G)[sP] · [LR](G)[sP] · [dR](C)[sP] · [dR](T)[sP] · [LR](A)[sP] · [LR]([5meC] |
| SEQ ID 228 | [LR](G)[sP] · [dR](G)[sP] · [dR](C)[sP] · [LR]([5meC])[sP] · [dR](A)[sP] · [LR](G)[sP] · [dR](G)[sP] · [dR](G)[sP] · [LR](A)[sP] · [dR](T)[sP] · [dR](C)[sP] · [LR](A)[sP] · [dR](G)[sP] · [dR](G)[sP] · [LR](G)[sP] · [dR](C)[sP] · [LR](T)[sP] · [LR](A) |

| SEQ ID | HELM, 5' - 3' direction |
|---|---|
| SEQ ID 229 | [LR](T)[sP] · [dR](G)[sP] · [LR](G)[sP] · [dR](C)[sP] · [dR](C)[sP] · [LR](A)[sP] · [dR](G)[sP] · [dR](G)[sP] · [LR](G)[sP] · [dR](A)[sP] · [LR](T)[sP] · [dR](C)[sP] · [dR](A)[sP] · [LR](G)[sP] · [dR](G)[sP] · [dR](G)[sP] · [LR]([5meC])[sP] · [LR](T) |
| SEQ ID 230 | [LR](T)[sP] · [dR](T)[sP] · [dR](G)[sP] · [LR](G)[sP] · [dR](C)[sP] · [dR](C)[sP] · [LR](A)[sP] · [dR](G)[sP] · [dR](G)[sP] · [LR](G)[sP] · [dR](A)[sP] · [LR](T)[sP] · [dR](C)[sP] · [LR](A)[sP] · [dR](G)[sP] · [dR](G)[sP] · [LR](G)[sP] · [LR]([5meC) |
| SEQ ID 231 | [LR](A)[sP] · [dR](T)[sP] · [LR](T)[sP] · [dR](G)[sP] · [LR](G)[sP] · [dR](T)[sP] · [dR](C)[sP] · [LR](A)[sP] · [dR](G)[sP] · [LR](G)[sP] · [dR](A)[sP] · [dR](T)[sP] · [LR]([5meC])[sP] · [dR](A)[sP] · [dR](G)[sP] · [LR](G)[sP] · [LR](G) |
| SEQ ID 232 | [LR]([5meC])[sP] · [dR](A)[P] · [LR](T)[sP] · [dR](T)[sP] · [dR](G)[sP] · [LR](G)[sP] · [dR](C)[sP] · [dR](C)[sP] · [LR](A)[sP] · [dR](G)[sP] · [dR](G)[sP] · [LR](G)[sP] · [dR](A)[sP] · [LR](T)[sP] · [dR](C)[sP] · [dR](A)[sP] · [LR](G)[sP] · [LR](G) |
| SEQ ID 233 | [LR]([5meC])[sP] · [dR](C)[sP] · [dR](A)[sP] · [LR](T)[sP] · [dR](T)[sP] · [dR](G)[sP] · [LR](G)[sP] · [dR](C)[sP] · [dR](C)[sP] · [LR](A)[sP] · [dR](G)[sP] · [dR](G)[sP] · [LR](G)[sP] · [dR](A)[sP] · [LR](T)[sP] · [dR](C)[sP] · [LR](A)[sP] · [LR](G) |
| SEQ ID 234 | [LR](T)[sP] · [dR](C)[sP] · [dR](C)[sP] · [LR](A)[sP] · [dR](T)[sP] · [LR](T)[sP] · [dR](G)[sP] · [LR](G)[sP] · [dR](C)[sP] · [dR](C)[sP] · [LR](A)[sP] · [dR](G)[sP] · [dR](G)[sP] · [LR](G)[sP] · [dR](A)[sP] · [dR](T)[sP] · [LR]([5meC])[sP] · [LR](A) |
| SEQ ID 235 | [LR](T)[sP] · [dR](T)[sP] · [dR](C)[sP] · [LR]([5meC])[sP] · [dR](A)[sP] · [LR](T)[sP] · [dR](G)[sP] · [LR](G)[sP] · [dR](C)[sP] · [dR](C)[sP] · [LR](A)[sP] · [dR](G)[sP] · [dR](G)[sP] · [LR](G)[sP] · [dR](A)[sP] · [LR](T)[sP] · [LR]([5meC) |
| SEQ ID 236 | [LR](T)[sP] · [dR](T)[sP] · [LR](T)[sP] · [dR](C)[sP] · [dR](C)[sP] · [LR](A)[sP] · [dR](T)[sP] · [dR](T)[sP] · [LR](G)[sP] · [dR](G)[sP] · [dR](C)[sP] · [LR]([5meC])[sP] · [dR](A)[sP] · [LR](G)[sP] · [dR](G)[sP] · [dR](G)[sP] · [LR](A)[sP] · [LR](T) |
| SEQ ID 237 | [LR](G)[sP] · [dR](T)[sP] · [dR](T)[sP] · [LR](T)[sP] · [dR](C)[sP] · [dR](C)[sP] · [LR](A)[sP] · [dR](T)[sP] · [LR](T)[sP] · [dR](G)[sP] · [LR](G)[sP] · [dR](C)[sP] · [dR](C)[sP] · [LR](A)[sP] · [dR](G)[sP] · [dR](G)[sP] · [LR](G)[sP] · [LR](A) |
| SEQ ID 238 | [LR](A)[sP] · [dR](G)[sP] · [LR](T)[sP] · [dR](T)[sP] · [LR](T)[sP] · [dR](C)[sP] · [dR](C)[sP] · [LR](A)[sP] · [dR](T)[sP] · [dR](T)[sP] · [LR](G)[sP] · [dR](G)[sP] · [dR](C)[sP] · [LR]([5meC])[sP] · [dR](A)[sP] · [dR](G)[sP] · [LR](G)[sP] · [LR](G) |
| SEQ ID 239 | [LR]([5meC])[sP] · [dR](A)[sP] · [dR](G)[sP] · [LR](T)[sP] · [dR](T)[sP] · [LR](T)[sP] · [dR](C)[sP] · [dR](C)[sP] · [LR](A)[sP] · [dR](T)[sP] · [dR](T)[sP] · [LR](G)[sP] · [dR](G)[sP] · [dR](C)[sP] · [LR]([5meC])[sP] · [dR](A)[sP] · [LR](G)[sP] · [LR](G) |
| SEQ ID 240 | [LR](T)[sP] · [dR](C)[sP] · [LR](A)[sP] · [dR](G)[sP] · [dR](T)[sP] · [LR](T)[sP] · [dR](T)[sP] · [dR](C)[sP] · [LR]([5meC])[sP] · [dR](A)[sP] · [LR](T)[sP] · [dR](T)[sP] · [dR](G)[sP] · [LR](G)[sP] · [dR](C)[sP] · [dR](C)[sP] · [LR](A)[sP] · [LR](G) |
| SEQ ID 241 | [LR]([5meC])[sP] · [dR](T)[sP] · [dR](C)[sP] · [LR](A)[sP] · [dR](G)[sP] · [LR](T)[sP] · [dR](T)[sP] · [LR](T)[sP] · [dR](C)[sP] · [dR](C)[sP] · [LR](A)[sP] · [dR](T)[sP] · [dR](T)[sP] · [LR](G)[sP] · [dR](G)[sP] · [dR](C)[sP] · [LR]([5meC])[sP] · [LR](A) |
| SEQ ID 242 | [LR]([5meC])[sP] · [dR](C)[sP] · [dR](T)[sP] · [LR]([5meC])[sP] · [dR](A)[sP] · [dR](G)[sP] · [LR](T)[sP] · [dR](T)[sP] · [LR](T)[sP] · [dR](C)[sP] · [dR](C)[sP] · [LR](A)[sP] · [dR](T)[sP] · [LR](T)[sP] · [dR](G)[sP] · [dR](G)[sP] · [LR]([5meC])[sP] · [LR]([5meC) |
| SEQ ID 243 | [LR](A)[sP] · [dR](C)[sP] · [dR](C)[sP] · [LR](T)[sP] · [dR](C)[sP] · [LR](A)[sP] · [dR](G)[sP] · [dR](T)[sP] · [LR](T)[sP] · [dR](T)[sP] · [dR](C)[sP] · [LR]([5meC])[sP] · [dR](A)[sP] · [LR](T)[sP] · [dR](T)[sP] · [dR](G)[sP] · [LR](G)[sP] · [LR]([5meC) |
| SEQ ID 244 | [LR](T)[sP] · [dR](A)[sP] · [dR](C)[sP] · [LR]([5meC])[sP] · [dR](T)[sP] · [dR](C)[sP] · [LR](A)[sP] · [dR](G)[sP] · [LR](T)[sP] · [dR](T)[sP] · [LR](T)[sP] · [dR](C)[sP] · [dR](C)[sP] · [LR](A)[sP] · [dR](T)[sP] · [dR](T)[sP] · [LR](G)[sP] · [LR](G) |
| SEQ ID 245 | [LR]([5meC])[sP] · [dR](T)[sP] · [LR](A)[sP] · [dR](C)[sP] · [dR](C)[sP] · [LR](T)[sP] · [dR](C)[sP] · [dR](A)[sP] · [LR](G)[sP] · [dR](T)[sP] · [dR](T)[sP] · [LR](T)[sP] · [dR](C)[sP] · [dR](C)[sP] · [LR](A)[sP] · [dR](T)[sP] · [LR](T)[sP] · [LR](G) |
| SEQ ID 246 | [LR]([5meC])[sP] · [dR](C)[sP] · [dR](T)[sP] · [LR](A)[sP] · [dR](C)[P] · [dR](C)[sP] · [LR](T)[sP] · [dR](C)[sP] · [LR](A)[sP] · [dR](G)[P] · [dR](T)[sP] · [LR](T)[sP] · [dR](T)[sP] · [dR](C)[sP] · [LR]([5meC])[sP] · [dR](A)[sP] · [LR](T)[sP] · [LR](T) |
| SEQ ID 247 | [LR](T)[sP] · [dR](G)[sP] · [dR](C)[sP] · [LR](A)[sP] · [dR](G)[sP] · [dR](A)[sP] · [LR](G)[sP] · [dR](T)[sP] · [dR](C)[sP] · [LR](T)[sP] · [dR](T)[sP] · [dR](C)[sP] · [LR](A)[sP] · [dR](G)[sP] · [dR](T)[sP] · [dR](A)[sP] · [LR]([5meC])[sP] · [LR](T) |
| SEQ ID 248 | [LR](G)[sP] · [dR](G)[sP] · [dR](C)[sP] · [dR](T)[sP] · [LR](G)[sP] · [dR](C)[sP] · [dR](A)[sP] · [LR](G)[sP] · [LR](A)[sP] · [dR](G)[sP] · [dR](T)[sP] · [dR](C)[sP] · [LR](T)[sP] · [dR](T)[sP] · [dR](C)[sP] · [dR](A)[sP] · [LR](G)[sP] · [LR](T) |
| SEQ ID 249 | [LR](G)[sP] · [dR](A)[sP] · [dR](G)[sP] · [dR](G)[sP] · [LR](G)[sP] · [dR](C)[sP] · [dR](T)[sP] · [LR](G)[sP] · [dR](C)[sP] · [LR](A)[sP] · [dR](G)[sP] · [dR](A)[sP] · [dR](G)[sP] · [LR](T)[sP] · [dR](C)[sP] · [dR](T)[sP] · [LR](T)[sP] · [LR]([5meC) |
| SEQ ID 250 | [LR]([5meC])[sP] · [dR](C)[sP] · [dR](C)[sP] · [LR](G)[sP] · [dR](A)[sP] · [dR](G)[sP] · [dR](G)[sP] · [LR](G)[sP] · [dR](C)[sP] · [dR](T)[sP] · [LR](G)[sP] · [dR](C)[sP] · [LR](A)[sP] · [dR](G)[sP] · [dR](A)[sP] · [dR](C)[sP] · [LR](T)[sP] · [LR]([5meC) |
| SEQ ID 251 | [LR](G)[sP] · [dR](G)[sP] · [dR](T)[sP] · [dR](C)[sP] · [LR]([5meC])[sP] · [dR](C)[sP] · [LR](G)[sP] · [dR](A)[sP] · [dR](G)[sP] · [dR](G)[sP] · [LR](G)[sP] · [dR](C)[sP] · [dR](T)[sP] · [LR](G)[sP] · [dR](C)[sP] · [dR](A)[sP] · [LR](G)[sP] · [LR](A) |
| SEQ ID 252 | [LR](T)[sP] · [dR](G)[sP] · [dR](G)[sP] · [dR](T)[sP] · [LR](G)[sP] · [dR](C)[sP] · [LR]([5meC])[sP] · [dR](C)[sP] · [LR](G)[sP] · [dR](A)[sP] · [dR](G)[sP] · [dR](G)[sP] · [LR](G)[sP] · [dR](C)[sP] · [dR](T)[sP] · [LR](G)[sP] · [LR]([5meC) |
| SEQ ID 253 | [LR](G)[sP] · [dR](A)[sP] · [dR](G)[sP] · [dR](T)[sP] · [LR](G)[sP] · [dR](G)[sP] · [dR](G)[sP] · [dR](G)[sP] · [LR](T)[sP] · [dR](C)[sP] · [dR](C)[sP] · [dR](C)[sP] · [LR](G)[sP] · [dR](A)[sP] · [dR](G)[sP] · [dR](G)[sP] · [LR](G)[sP] · [LR]([5meC) |

| SEQ ID | HELM, 5' - 3' direction |
|---|---|
| SEQ ID 254 | [LR](T)[sP] · [dR](C)[sP] · [dR](C)[sP] · [LR](G)[sP] · [dR](A)[sP] · [dR](G)[sP] · [dR](T)[sP] · [LR](G)[sP] · [dR](G)[sP] · [dR](G)[sP] · [dR](G)[sP] · [LR](T)[sP] · [dR](C)[sP] · [dR](C)[sP] · [LR]([5meC])[sP] · [dR](G)[sP] · [LR](A)[sP] · [LR](A) |
| SEQ ID 255 | [LR]([5meC])[sP] · [dR](C)[sP] · [dR](C)[sP] · [LR](T)[sP] · [dR](C)[sP] · [dR](C)[sP] · [LR](G)[sP] · [dR](A)[sP] · [dR](G)[sP] · [dR](T)[sP] · [LR](G)[sP] · [dR](G)[sP] · [dR](G)[sP] · [dR](G)[sP] · [LR](T)[sP] · [dR](C)[sP] · [LR]([5meC])[sP] · [LR]([5meC]) |
| SEQ ID 256 | [LR](G)[sP] · [dR](C)[sP] · [LR](A)[sP] · [dR](C)[sP] · [dR](C)[sP] · [dR](C)[sP] · [LR](T)[sP] · [dR](C)[sP] · [dR](C)[sP] · [LR](G)[sP] · [dR](A)[sP] · [dR](G)[sP] · [dR](T)[sP] · [LR](G)[sP] · [dR](G)[sP] · [dR](G)[sP] · [LR](G)[sP] · [LR](T) |
| SEQ ID 257 | [LR](A)[sP] · [dR](G)[sP] · [dR](G)[sP] · [LR](G)[sP] · [dR](C)[sP] · [LR](A)[sP] · [dR](C)[sP] · [dR](C)[sP] · [dR](C)[sP] · [LR](T)[sP] · [dR](C)[sP] · [dR](C)[sP] · [LR](G)[sP] · [dR](A)[sP] · [dR](G)[sP] · [dR](T)[sP] · [LR](G)[sP] · [LR](G) |
| SEQ ID 258 | [LR]([5meC])[sP] · [dR](A)[sP] · [dR](G)[sP] · [dR](A)[sP] · [LR](G)[sP] · [dR](G)[sP] · [dR](G)[sP] · [dR](C)[sP] · [LR](A)[sP] · [dR](C)[sP] · [dR](C)[sP] · [dR](C)[sP] · [LR](T)[sP] · [dR](C)[sP] · [dR]([5meC])[sP] · [dR](G)[sP] · [LR](A)[sP] · [LR](G) |
| SEQ ID 259 | [LR](G)[sP] · [dR](A)[sP] · [dR](G)[sP] · [dR](C)[sP] · [LR](A)[sP] · [dR](G)[sP] · [dR](A)[sP] · [dR](G)[sP] · [LR](G)[sP] · [dR](G)[sP] · [dR](C)[sP] · [dR](A)[sP] · [LR]([5meC])[sP] · [dR](C)[sP] · [dR](C)[sP] · [dR](T)[sP] · [LR]([5meC])[sP] · [LR]([5meC]) |
| SEQ ID 260 | [LR]([5meC])[sP] · [dR](C)[sP] · [dR](T)[sP] · [LR](G)[sP] · [dR](A)[sP] · [dR](G)[sP] · [dR](C)[sP] · [LR](A)[sP] · [dR](G)[sP] · [dR](A)[sP] · [dR](G)[sP] · [dR](G)[sP] · [dR](G)[sP] · [dR](C)[sP] · [LR](A)[sP] · [dR](C)[sP] · [LR]([5meC])[sP] · [LR]([5meC]) |
| SEQ ID 261 | [LR](A)[sP] · [dR](G)[sP] · [dR](G)[sP] · [dR](C)[sP] · [LR]([5meC])[sP] · [dR](T)[sP] · [LR](G)[sP] · [dR](A)[sP] · [dR](G)[sP] · [dR](C)[sP] · [LR](A)[sP] · [dR](G)[sP] · [LR](A)[sP] · [dR](G)[sP] · [dR](G)[sP] · [dR](G)[sP] · [LR]([5meC])[sP] · [LR](A) |
| SEQ ID 262 | [LR](G)[sP] · [dR](G)[sP] · [LR](G)[sP] · [dR](A)[sP] · [dR](G)[sP] · [LR](G)[sP] · [dR](C)[sP] · [dR](C)[sP] · [dR](T)[sP] · [LR](G)[sP] · [dR](A)[sP] · [dR](G)[sP] · [dR](C)[sP] · [LR](A)[sP] · [dR](G)[sP] · [dR](A)[sP] · [LR](G)[sP] · [LR](G) |
| SEQ ID 263 | [LR]([5meC])[sP] · [dR](T)[sP] · [LR](A)[sP] · [dR](G)[sP] · [dR](G)[sP] · [LR](G)[sP] · [dR](A)[sP] · [dR](G)[sP] · [LR](G)[sP] · [dR](C)[sP] · [dR](C)[sP] · [dR](T)[sP] · [LR](G)[sP] · [dR](A)[sP] · [dR](G)[sP] · [dR](C)[sP] · [LR](A)[sP] · [LR](G) |
| SEQ ID 264 | [LR](G)[sP] · [dR](T)[sP] · [LR](G)[sP] · [dR](C)[sP] · [dR](T)[sP] · [LR](A)[sP] · [dR](G)[sP] · [dR](G)[sP] · [LR](G)[sP] · [dR](A)[sP] · [dR](G)[sP] · [dR](G)[sP] · [LR]([5meC])[sP] · [dR](C)[sP] · [dR](T)[sP] · [dR](G)[sP] · [LR](A)[sP] · [LR](G) |
| SEQ ID 265 | [LR](G)[sP] · [dR](A)[sP] · [dR](G)[sP] · [dR](G)[sP] · [LR](T)[sP] · [dR](G)[sP] · [dR](C)[sP] · [dR](T)[sP] · [LR](A)[sP] · [dR](G)[sP] · [dR](G)[sP] · [dR](G)[sP] · [LR](A)[sP] · [dR](G)[sP] · [dR](G)[sP] · [dR](C)[sP] · [LR]([5meC])[sP] · [LR](T) |
| SEQ ID 266 | [LR](G)[sP] · [dR](G)[sP] · [dR](G)[sP] · [dR](G)[sP] · [LR](A)[sP] · [dR](G)[sP] · [dR](G)[sP] · [dR](T)[sP] · [LR](G)[sP] · [dR](C)[sP] · [dR](T)[sP] · [LR](A)[sP] · [dR](G)[sP] · [dR](G)[sP] · [dR](G)[sP] · [LR](G)[sP] · [LR](G) |
| SEQ ID 267 | [LR](T)[sP] · [dR](A)[sP] · [dR](G)[sP] · [LR](G)[sP] · [dR](G)[sP] · [dR](G)[sP] · [dR](G)[sP] · [LR](A)[sP] · [dR](G)[sP] · [dR](G)[sP] · [dR](T)[sP] · [LR](G)[sP] · [dR](C)[sP] · [dR](T)[sP] · [LR](A)[sP] · [dR](G)[sP] · [LR](G)[sP] · [LR](G) |
| SEQ ID 268 | [LR](G)[sP] · [dR](G)[sP] · [dR](T)[sP] · [dR](T)[sP] · [LR](A)[sP] · [dR](G)[sP] · [dR](G)[sP] · [dR](G)[sP] · [LR](G)[sP] · [dR](A)[sP] · [dR](G)[sP] · [LR](G)[sP] · [dR](T)[sP] · [dR](G)[sP] · [dR](C)[sP] · [LR](T)[sP] · [LR](A) |
| SEQ ID 269 | [LR](T)[sP] · [dR](T)[sP] · [dR](T)[sP] · [dR](G)[sP] · [LR](G)[sP] · [dR](T)[sP] · [dR](T)[sP] · [dR](A)[sP] · [LR](G)[sP] · [dR](G)[sP] · [dR](G)[sP] · [dR](G)[sP] · [LR](G)[sP] · [dR](A)[sP] · [dR](G)[sP] · [dR](G)[sP] · [LR](T)[sP] · [LR](G) |
| SEQ ID 270 | [LR](G)[sP] · [dR](A)[sP] · [LR](A)[sP] · [dR](T)[sP] · [LR](T)[sP] · [dR](T)[sP] · [dR](G)[sP] · [dR](G)[sP] · [LR](T)[sP] · [LR](T)[sP] · [dR](A)[sP] · [dR](G)[sP] · [LR](G)[sP] · [dR](G)[sP] · [dR](G)[sP] · [dR](G)[sP] · [LR](A)[sP] · [LR](G) |
| SEQ ID 271 | [LR](G)[sP] · [dR](G)[sP] · [dR](A)[sP] · [LR](G)[sP] · [dR](A)[sP] · [LR](A)[sP] · [dR](T)[sP] · [LR](T)[sP] · [dR](T)[sP] · [LR](G)[sP] · [dR](G)[sP] · [dR](T)[sP] · [dR](T)[sP] · [LR](A)[sP] · [dR](G)[sP] · [dR](G)[sP] · [LR](G)[sP] · [LR](G) |
| SEQ ID 272 | [LR]([5meC])[sP] · [LR](A)[sP] · [dR](G)[sP] · [LR](G)[sP] · [dR](G)[sP] · [dR](A)[sP] · [dR](G)[sP] · [LR](A)[sP] · [LR](A)[sP] · [dR](T)[sP] · [dR](T)[sP] · [LR](T)[sP] · [dR](G)[sP] · [dR](G)[sP] · [LR](T)[sP] · [dR](T)[sP] · [LR](A)[sP] · [LR](G) |
| SEQ ID 273 | [LR](G)[sP] · [dR](T)[sP] · [dR](C)[sP] · [dR](C)[sP] · [LR](A)[sP] · [dR](G)[sP] · [dR](G)[sP] · [LR](G)[sP] · [dR](A)[sP] · [dR](G)[sP] · [LR](A)[sP] · [LR](G)[sP] · [dR](T)[sP] · [LR](T)[sP] · [dR](T)[sP] · [dR](G)[sP] · [LR](G)[sP] · [LR](T) |
| SEQ ID 274 | [LR](G)[sP] · [dR](G)[sP] · [dR](G)[sP] · [dR](G)[sP] · [LR](T)[sP] · [dR](C)[sP] · [dR](C)[sP] · [LR](A)[sP] · [dR](G)[sP] · [dR](G) [sP] · [LR](G)[sP] · [dR](A)[sP] · [dR](G)[sP] · [dR](A)[sP] · [LR](A)[sP] · [dR](T)[sP] · [LR](T)[sP] · [LR](T) |
| SEQ ID 275 | [LR](A)[sP] · [dR](A)[sP] · [dR](G)[sP] · [LR](G)[sP] · [dR](G)[sP] · [dR](G)[sP] · [LR](G)[sP] · [dR](T)[sP] · [dR](C)[sP] · [LR](A)[sP] · [dR](G)[sP] · [dR](G)[sP] · [LR](G)[sP] · [dR](A)[sP] · [dR](G)[sP] · [LR](A)[sP] · [LR](A) |
| SEQ ID 276 | [LR]([5meC])[sP] · [dR](A)[sP] · [dR](G)[sP] · [dR](A)[sP] · [LR](A)[sP] · [dR](T)[sP] · [dR](G)[sP] · [dR](G)[sP] · [LR](G)[sP] · [dR](G)[sP] · [dR](T)[sP] · [dR](C)[sP] · [LR]([5meC])[sP] · [dR](A)[sP] · [dR](G)[sP] · [LR](G)[sP] · [LR](A) |
| SEQ ID 277 | [LR](G)[sP] · [dR](C)[sP] · [dR](T)[sP] · [dR](C)[sP] · [LR](G)[sP] · [dR](A)[sP] · [dR](G)[sP] · [dR](A)[sP] · [dR](A)[sP] · [LR](T)[sP] · [dR](G)[sP] · [dR](G)[sP] · [dR](G)[sP] · [LR](G)[sP] · [dR](T)[sP] · [dR](C)[sP] · [LR](A)[sP] · [LR]G |
| SEQ ID 278 | [LR](G)[sP] · [dR](G)[sP] · [dR](A)[sP] · [LR](G)[sP] · [dR](C)[sP] · [dR](T)[sP] · [dR](C)[sP] · [LR](A)[sP] · [dR](G)[sP] · [dR](A)[sP] · [LR](A)[sP] · [dR](T)[sP] · [LR](G)[sP] · [dR](G)[sP] · [dR](G)[sP] · [dR](G)[sP] · [LR](T)[sP] · [LR]([5meC]) |

-continued

| SEQ ID | HELM, 5' - 3' direction |
|---|---|
| SEQ ID 279 | [LR](T)[sP] · [dR](G)[sP] · [dR](G)[sP] · [dR](G)[sP] · [LR](G)[sP] · [dR](A)[sP] · [dR](G)[sP] · [dR](C)[sP] · [LR](T)[sP] · [dR](C)[sP] · [dR](A)[sP] · [dR](G)[sP] · [LR](A)[sP] · [dR](A)[sP] · [dR](T)[sP] · [dR](G)[sP] · [LR](G)[sP] · [LR](G) |
| SEQ ID 280 | [LR](T)[sP] · [dR](G)[sP] · [LR](A)[sP] · [dR](T)[sP] · [dR](G)[sP] · [LR](G)[sP] · [dR](G)[sP] · [dR](G)[sP] · [dR](A)[sP] · [LR](G)[sP] · [dR](C)[sP] · [dR](T)[sP] · [dR](C)[sP] · [LR](A)[sP] · [dR](G)[sP] · [dR](A)[sP] · [LR](A)[sP] · [LR](T) |
| SEQ ID 281 | [LR](T)[sP] · [dR](G)[sP] · [dR](G)[sP] · [dR](T)[sP] · [LR](G)[sP] · [dR](A)[sP] · [dR](T)[sP] · [LR](G)[sP] · [dR](G)[sP] · [dR](G)[sP] · [LR](G)[sP] · [dR](A)[sP] · [dR](G)[sP] · [dR](C)[sP] · [LR](T)[sP] · [dR](C)[sP] · [LR](A)[sP] · [LR](G) |
| SEQ ID 282 | [LR]([5meC])[sP] · [dR](C)[sP] · [dR](A)[sP] · [dR](T)[sP] · [LR](G)[sP] · [dR](G)[sP] · [dR](T)[sP] · [LR](G)[sP] · [dR](A)[sP] · [dR](T)[sP] · [LR](G)[sP] · [dR](G)[sP] · [dR](G)[sP] · [LR](G)[sP] · [dR](A)[sP] · [dR](G)[sP] · [LR]([5meC])[sP] · [LR](T) |
| SEQ ID 283 | [LR]([5meC])[sP] · [dR](T)[sP] · [dR](C)[sP] · [dR](C)[sP] · [LR]([5meC])[sP] · [dR](A)[sP] · [dR](T)[sP] · [LR](G)[sP] · [dR](G)[sP] · [dR](T)[sP] · [LR](G)[sP] · [dR](A)[sP] · [dR](T)[sP] · [LR](G)[sP] · [dR](G)[sP] · [dR](G)[sP] · [LR](G)[sP] · [LR](A) |
| SEQ ID 284 | [LR]([5meC])[sP] · [dR](A)[sP] · [dR](C)[sP] · [dR](C)[sP] · [LR](T)[sP] · [dR](C)[sP] · [dR](C)[sP] · [dR](C)[sP] · [LR](A)[sP] · [dR](T)[sP] · [LR](G)[sP] · [dR](G)[sP] · [dR](T)[sP] · [LR](G)[sP] · [dR](A)[sP] · [dR](T)[sP] · [LR](G)[sP] · [LR](G) |
| SEQ ID 285 | [LR]([5meC])[sP] · [dR](C)[sP] · [dR](C)[sP] · [dR](C)[sP] · [LR](A)[sP] · [dR](C)[sP] · [dR](C)[sP] · [LR](T)[sP] · [dR](C)[sP] · [dR](C)[sP] · [dR](C)[sP] · [LR](A)[sP] · [dR](T)[sP] · [LR](G)[sP] · [dR](G)[sP] · [dR](T)[sP] · [LR](G)[sP] · [LR](A) |
| SEQ ID 286 | [LR](A)[sP] · [dR](G)[sP] · [dR](G)[sP] · [dR](C)[sP] · [LR]([5meC])[sP] · [dR](C)[sP] · [dR](C)[sP] · [LR](A)[sP] · [dR](C)[sP] · [dR](C)[sP] · [LR](T)[sP] · [dR](C)[sP] · [dR](C)[sP] · [dR](C)[sP] · [LR](A)[sP] · [dR](T)[sP] · [LR](G)[sP] · [LR](G) |
| SEQ ID 287 | [LR](T)[sP] · [dR](T)[sP] · [LR](G)[sP] · [dR](A)[sP] · [dR](G)[sP] · [dR](G)[sP] · [LR]([5meC])[sP] · [dR](C)[sP] · [dR](C)[sP] · [dR](C)[sP] · [LR](A)[sP] · [dR](C)[sP] · [dR](C)[sP] · [LR](T)[sP] · [dR](C)[sP] · [dR](C)[sP] · [LR]([5meC])[sP] · [LR](A) |
| SEQ ID 288 | [LR](A)[sP] · [dR](G)[sP] · [dR](A)[sP] · [LR](T)[sP] · [dR](T)[sP] · [LR](G)[sP] · [dR](A)[sP] · [dR](G)[sP] · [dR](G)[sP] · [LR]([5meC])[sP] · [dR](C)[sP] · [dR](C)[sP] · [dR](C)[sP] · [LR](A)[sP] · [dR](C)[sP] · [dR](C)[sP] · [LR](T)[sP] · [LR]([5meC]) |
| SEQ ID 289 | [LR]([5meC])[sP] · [dR](T)[sP] · [dR](T)[sP] · [dR](A)[sP] · [LR](G)[sP] · [dR](A)[sP] · [dR](T)[sP] · [dR](T)[sP] · [LR](G)[sP] · [dR](A)[sP] · [dR](G)[sP] · [dR](G)[sP] · [LR]([5meC])[sP] · [dR](C)[sP] · [dR](C)[sP] · [dR](C)[sP] · [LR](A)[sP] · [LR]([5meC]) |
| SEQ ID 290 | [LR](G)[sP] · [dR](G)[sP] · [dR](C)[sP] · [dR](C)[sP] · [LR](T)[sP] · [dR](T)[sP] · [dR](A)[sP] · [dR](G)[sP] · [LR](A)[sP] · [dR](T)[sP] · [dR](T)[sP] · [dR](G)[sP] · [LR](A)[sP] · [dR](G)[sP] · [dR](G)[sP] · [dR](C)[sP] · [LR]([5meC])[sP] · [LR]([5meC]) |
| SEQ ID 291 | [LR](G)[sP] · [dR](A)[sP] · [LR](A)[sP] · [dR](G)[sP] · [LR](G)[sP] · [dR](C)[sP] · [dR](C)[sP] · [dR](T)[sP] · [LR](T)[sP] · [dR](A)[sP] · [dR](G)[sP] · [dR](A)[sP] · [LR](T)[sP] · [dR](T)[sP] · [LR](G)[sP] · [dR](A)[sP] · [LR](G)[sP] · [LR](G) |
| SEQ ID 292 | [LR](A)[sP] · [dR](G)[sP] · [dR](G)[sP] · [LR](G)[sP] · [dR](A)[sP] · [dR](A)[sP] · [dR](G)[sP] · [LR](G)[sP] · [dR](C)[sP] · [dR](C)[sP] · [dR](T)[sP] · [LRP](T)[sP] · [dR](A)[sP] · [dR](G)[sP] · [LR](A)[sP] · [dR](T)[sP] · [LR](T)[sP] · [LR](G) |
| SEQ ID 293 | [LR](G)[sP] · [dR](A)[sP] · [dR](C)[sP] · [LR](A)[sP] · [dR](G)[sP] · [dR](G)[sP] · [dR](A)[sP] · [LR](A)[sP] · [dR](A)[sP] · [dR](G)[sP] · [dR](G)[sP] · [dR](C)[sP] · [dR](C)[sP] · [LR](T)[sP] · [dR](T)[sP] · [dR](A)[sP] · [LR](G)[sP] · [LR](A) |
| SEQ ID 294 | [LR](T)[sP] · [dR](C)[sP] · [dR](T)[sP] · [LR](G)[sP] · [dR](A)[sP] · [dR](C)[sP] · [LR](A)[sP] · [dR](G)[sP] · [dR](G)[sP] · [dR](G)[sP] · [LR](A)[sP] · [dR](A)[sP] · [dR](G)[sP] · [LR](G)[sP] · [dR](C)[sP] · [dR](C)[sP] · [LR](T)[sP] · [LR](T) |
| SEQ ID 295 | [LR]([5meC])[sP] · [dR](C)[sP] · [dR](T)[sP] · [LR](T)[sP] · [dR](C)[sP] · [dR](T)[sP] · [LR](G)[sP] · [dR](A)[sP] · [dR](C)[sP] · [LR](A)[sP] · [dR](G)[sP] · [dR](G)[sP] · [dR](G)[sP] · [LR](A)[sP] · [dR](A)[sP] · [dR](G)[sP] · [LR](G)[sP] · [LR]([5meC]) |
| SEQ ID 296 | [LR]([5meC])[sP] · [dR](C)[sP] · [LR]([5meC])[sP] · [dR](C)[sP] · [dR](C)[sP] · [dR](T)[sP] · [LR](T)[sP] · [dR](C)[sP] · [dR](T)[sP] · [LR](G)[sP] · [dR](A)[sP] · [dR](C)[sP] · [LR](A)[sP] · [dR](G)[sP] · [dR](G)[sP] · [dR](G)[sP] · [LR](A)[sP] · [LR](A) |
| SEQ ID 297 | [LR]([5meC])[sP] · [dR](A)[sP] · [dR](A)[sP] · [dR](C)[sP] · [LR]([5meC])[sP] · [dR](C)[sP] · [dR](C)[sP] · [dR](C)[sP] · [LR](T)[sP] · [dR](T)[sP] · [dR](C)[sP] · [dR](T)[sP] · [LR](G)[sP] · [dR](A)[sP] · [dR](C)[sP] · [dR](A)[sP] · [LR](G)[sP] · [LR](G) |
| SEQ ID 298 | [LR]([5meC])[sP] · [dR](C)[sP] · [dR](A)[sP] · [dR](C)[sP] · [LR](A)[sP] · [dR](A)[sP] · [dR](C)[sP] · [dR](C)[sP] · [LR]([5meC])[sP] · [dR](C)[sP] · [dR](C)[sP] · [dR](T)[sP] · [LR](T)[sP] · [dR](C)[sP] · [dR](T)[sP] · [dR](G)[sP] · [LR](A)[sP] · [LR]([5meC]) |
| SEQ ID 299 | [LR](T)[sP] · [dR](T)[sP] · [LR](G)[sP] · [dR](C)[sP] · [dR](C)[sP] · [LR](A)[sP] · [dR](C)[sP] · [dR](A)[sP] · [LR](A)[sP] · [dR](C)[sP] · [dR](C)[sP] · [dR](A)[sP] · [LR]([5meC])[sP] · [dR](C)[sP] · [dR](T)[sP] · [dR](T)[sP] · [LR]([5meC])[sP] · [LR](T) |
| SEQ ID 300 | [LR]([5meC])[sP] · [dR](T)[sP] · [LR](T)[sP] · [dR](C)[sP] · [dR](C)[sP] · [LR](T)[sP] · [LR](G)[sP] · [dR](C)[sP] · [dR](C)[sP] · [LR](A)[sP] · [dR](C)[sP] · [dR](A)[sP] · [LR](A)[sP] · [dR](C)[sP] · [dR](C)[sP] · [LR]([5meC])[sP] · [LR](T) |
| SEQ ID 301 | [LR](T)[sP] · [dR](G)[sP] · [dR](G)[sP] · [LR](T)[sP] · [dR](T)[sP] · [dR](T)[sP] · [dR](T)[sP] · [LR](G)[sP] · [dR](C)[sP] · [dR](C)[sP] · [LR](A)[sP] · [dR](C)[sP] · [LR](A)[sP] · [dR](A)[sP] · [dR](C)[sP] · [LR]([5meC])[sP] · [LR]([5meC]) |
| SEQ ID 302 | [LR](A)[sP] · [dR](T)[sP] · [LR](G)[sP] · [LR]([5meC])[sP] · [dR](T)[sP] · [dR](T)[sP] · [LR](T)[sP] · [dR](T)[sP] · [dR](G)[sP] · [dR](C)[sP] · [LR]([5meC])[sP] · [dR](A)[sP] · [dR](C)[sP] · [LR](A)[sP] · [LR](A) |
| SEQ ID 303 | [LR](G)[sP] · [dR](T)[sP] · [LR](A)[sP] · [dR](A)[sP] · [dR](T)[sP] · [LR](G)[sP] · [dR](T)[sP] · [dR](G)[sP] · [LR](G)[sP] · [dR](C)[sP] · [dR](T)[sP] · [dR](T)[sP] · [LR](T)[sP] · [dR](T)[sP] · [dR](G)[sP] · [dR](C)[sP] · [LR]([5meC])[sP] · [LR](A) |

-continued

| SEQ ID | HELM, 5' - 3' direction |
|---|---|
| SEQ ID 304 | [LR]([5meC])[sP] · [dR](T)[sP] · [dR](T)[sP] · [dR](G)[sP] · [LR](T)[sP] · [dR](A)[sP] · [dR](A)[sP] · [LR](T)[sP] · [dR](G)[sP] · [LR](T)[sP] · [dR](G)[sP] · [LR](G)[sP] · [dR](C)[sP] · [dR](T)[sP] · [dR](T)[sP] · [LR](T)[sP] · [LR](T)[sP] · [LR](G) |
| SEQ ID 305 | [LR]([5meC])[sP] · [dR](A)[sP] · [LR](G)[sP] · [dR](C)[sP] · [LR](T)[sP] · [dR](T)[sP] · [LR](G)[sP] · [dR](T)[sP] · [LR](A)[sP] · [LR](A)[sP] · [dR](T)[sP] · [LR](G)[sP] · [dR](T)[sP] · [LR](G)[sP] · [dR](G)[sP] · [dR](C)[sP] · [LR](T)[sP] · [LR](T) |
| SEQ ID 306 | [LR](T)[sP] · [dR](G)[sP] · [dR](G)[sP] · [LR]([5meC])[sP] · [dR](A)[sP] · [dR](G)[sP] · [dR](C)[sP] · [LR](T)[sP] · [dR](T)[sP] · [LR](G)[sP] · [dR](T))[sP] · [LR](A)[sP] · [dR](A)[sP] · [dR](T)[sP] · [LR](G)[sP] · [dR](T)[sP] · [LR](G)[sP] · [LR](G) |
| SEQ ID 307 | [LR](G)[sP] · [dR](G)[sP] · [LR](A)[sP] · [dR](T)[sP] · [dR](G)[sP] · [LR](G)[sP] · [dR](C)[sP] · [dR](A)[sP] · [LR](G)[sP] · [dR](C)[sP] · [dR](T)[sP] · [dR](T)[sP] · [LR](G)[sP] · [dR](T)[sP] · [LR](A)[sP] · [dR](A)[sP] · [LR](T)[sP] · [LR](G) |
| SEQ ID 308 | [LR](A)[sP] · [dR](G)[sP] · [dR](G)[sP] · [dR](G)[sP] · [LR](G)[sP] · [dR](A)[sP] · [dR](T)[sP] · [LR](G)[sP] · [dR](G)[sP] · [dR](C)[sP] · [LR](A)[sP] · [dR](G)[sP] · [dR](C)[sP] · [LR](T)[sP] · [dR](T)[sP] · [dR](G)[sP] · [LR](T)[sP] · [LR](A) |
| SEQ ID 309 | [LR](G)[sP] · [dR](G)[sP] · [dR](G)[sP] · [dR](A)[sP] · [dR](G)[sP] · [dR](G)[sP] · [dR](G)[sP] · [dR](G)[sP] · [LR](A)[sP] · [dR](T)[sP] · [dR](G)[sP] · [dR](G)[sP] · [LR]([5meC])[sP] · [dR](A)[sP] · [dR](G)[sP] · [dR](C)[sP] · [LR](T)[sP] · [LR](T) |
| SEQ ID 310 | [LR](A)[sP] · [dR](C)[sP] · [LR](G)[sP] · [dR](G)[sP] · [dR](G)[sP] · [dR](G)[sP] · [LR](A)[sP] · [dR](G)[sP] · [dR](G)[sP] · [dR](G)[sP] · [dR](A)[sP] · [dR](T)[sP] · [LR](G)[sP] · [dR](G)[sP] · [dR](C)[sP] · [LR](A)[sP] · [LR](G) |
| SEQ ID 311 | [LR](G)[sP] · [dR](A)[sP] · [LR](A)[sP] · [dR](A)[sP] · [dR](C)[sP] · [LR](G)[sP] · [dR](G)[sP] · [dR](G)[sP] · [dR](G)[sP] · [LR](A)[sP] · [dR](G)[sP] · [dR](G)[sP] · [LR](G)[sP] · [dR](A)[sP] · [dR](T)[sP] · [LR](G)[sP] · [LR](G) |
| SEQ ID 312 | [LR](A)[sP] · [dR](C)[sP] · [dR](T)[sP] · [LR](G)[sP] · [dR](A)[sP] · [LR](A)[sP] · [dR](A)[sP] · [dR](C)[sP] · [LR](G)[sP] · [dR](G)[sP] · [dR](G)[sP] · [dR](G)[sP] · [LR](A)[sP] · [dR](G)[sP] · [dR](G)[sP] · [LR](G)[sP] · [LR](A) |
| SEQ ID 313 | [LR](T)[sP] · [dR](C)[sP] · [dR](C)[sP] · [LR](A)[sP] · [dR](C)[sP] · [dR](T)[sP] · [LR](G)[sP] · [dR](A)[sP] · [dR](A)[sP] · [dR](A)[sP] · [LR]([5meC]) · [dR](G)[sP] · [dR](G)[sP] · [LR](G)[sP] · [dR](A)[sP] · [dR](G)[sP] · [LR](G) |
| SEQ ID 314 | [LR](G)[sP] · [dR](G)[sP] · [dR](G)[sP] · [LR](T)[sP] · [dR](C)[sP] · [dR](C)[sP] · [LR](A)[sP] · [dR](C)[sP] · [dR](T)[sP] · [LR](G)[sP] · [dR](A)[sP] · [dR](A)[sP] · [LR](A)[sP] · [dR]([5meC])[sP] · [dR](G)[sP] · [LR](G)[sP] · [LR](G) |
| SEQ ID 315 | [LR](A)[sP] · [dR](C)[sP] · [dR](A)[sP] · [LR](G)[sP] · [dR](G)[sP] · [LR](G)[sP] · [dR](T)[sP] · [dR](C)[sP] · [dR](C)[sP] · [LR](A)[sP] · [dR](C)[sP] · [dR](T)[sP] · [dR](G)[sP] · [LR](A)[sP] · [dR](A)[sP] · [dR](A)[sP] · [LR]([5meC])[sP] · [LR](G) |
| SEQ ID 316 | [LR](G)[sP] · [dR](C)[sP] · [dR](C)[sP] · [LR](A)[sP] · [dR](C)[sP] · [LR](A)[sP] · [dR](G)[sP] · [dR](G)[sP] · [dR](G)[sP] · [LR](T)[sP] · [dR](C)[sP] · [dR](C)[sP] · [LR](A)[sP] · [dR](C)[sP] · [dR](T)[sP] · [dR](G)[sP] · [LR](A) |
| SEQ ID 317 | [LR]([5meC])[sP] · [dR](T)[sP] · [dR](G)[sP] · [dR](G)[sP] · [LR]([5meC])[sP] · [dR](C)[sP] · [dR](A)[sP] · [dR](C)[sP] · [LR](A)[sP] · [dR](G)[sP] · [dR](G)[sP] · [dR](G)[sP] · [LR](T)[sP] · [dR](C)[sP] · [dR](C)[sP] · [dR](A)[sP] · [LR]([5meC])[sP] · [LR](T) |
| SEQ ID 318 | [LR]([5meC])[sP] · [dR](A)[sP] · [dR](C)[sP] · [dR](C)[sP] · [LR](T)[sP] · [dR](G)[sP] · [dR](G)[sP] · [dR](C)[sP] · [LR]([5meC])[sP] · [dR](A)[sP] · [dR](C)[sP] · [dR](A)[sP] · [LR](G)[sP] · [dR](G)[sP] · [dR](G)[sP] · [dR](T)[sP] · [LR]([5meC])[sP] · [LR]([5meC] |
| SEQ ID 319 | [LR](A)[sP] · [dR](A)[sP] · [dR](G)[sP] · [dR](C)[sP] · [LR](A)[sP] · [dR](C)[sP] · [dR](C)[sP] · [dR](T)[sP] · [LR](G)[sP] · [dR](G)[sP] · [dR](C)[sP] · [dR](C)[sP] · [LR](A)[sP] · [dR](C)[sP] · [dR](A)[sP] · [dR](G)[sP] · [LR](G)[sP] · [LR](G) |
| SEQ ID 320 | [LR](G)[sP] · [dR](A)[sP] · [dR](A)[sP] · [LR](A)[sP] · [dR](A)[sP] · [dR](G)[sP] · [dR](C)[sP] · [LR](A)[sP] · [dR](C)[sP] · [dR](C)[sP] · [dR](C)[sP] · [LR](G)[sP] · [dR](G)[sP] · [dR](C)[sP] · [dR](C)[sP] · [LR](A)[sP] · [LR]([5meC])[sP] · [LR](A) |
| SEQ ID 321 | [LR](A)[sP] · [dR](G)[sP] · [dR](G)[sP] · [dR](G)[sP] · [LR](A)[sP] · [dR](A)[sP] · [LR](A)[sP] · [dR](A)[sP] · [dR](G)[sP] · [dR](C)[sP] · [LR](A)[sP] · [dR](C)[sP] · [dR](C)[sP] · [dR](T)[sP] · [LR](G)[sP] · [dR](G)[sP] · [LR]([5meC])[sP] · [LR]([5meC] |
| SEQ ID 322 | [LR](G)[sP] · [dR](A)[sP] · [LR](T)[sP] · [dR](A)[sP] · [LR](G)[sP] · [dR](G)[sP] · [dR](G)[sP] · [dR](G)[sP] · [LR](A)[sP] · [dR](A)[sP] · [LR](A)[sP] · [LR](A)[sP] · [dR](G)[sP] · [LR]([5meC])[sP] · [dR](A)[sP] · [dR](C)[sP] · [LR](T)[sP] · [LR](G) |
| SEQ ID 323 | [LR](G)[sP] · [dR](T)[sP] · [dR](G)[sP] · [LR](G)[sP] · [LR](A)[sP] · [LR](T)[sP] · [dR](A)[sP] · [LR](G)[sP] · [dR](G)[sP] · [dR](G)[sP] · [dR](A)[sP] · [LR](A)[sP] · [LR](A)[sP] · [dR](A)[sP] · [dR](G)[sP] · [dR](C)[sP] · [LR]([A])[sP] · [LR]([5meC] |
| SEQ ID 324 | [LR]([5meC])[sP] · [dR](C)[sP] · [dR](T)[sP] · [LR](G)[sP] · [dR](T)[sP] · [dR](G)[sP] · [LR](G)[sP] · [dR](A)[sP] · [LR](T)[sP] · [dR](A)[sP] · [dR](G)[sP] · [LR](G)[sP] · [LR](G)[sP] · [dR](A)[sP] · [LR](A)[sP] · [dR](A)[sP] · [LR](A)[sP] · [LR](G) |
| SEQ ID 325 | [LR](A)[sP] · [dR](C)[sP] · [LR]([5meC])[sP] · [dR](C)[sP] · [dR](C)[sP] · [LR](T)[sP] · [LR](G)[sP] · [dR](T)[sP] · [dR](G)[sP] · [LR](G)[sP] · [dR](A)[sP] · [LR](T)[sP] · [LR](A)[sP] · [dR](G)[sP] · [dR](G)[sP] · [dR](G)[sP] · [LR](A)[sP] · [LR](A) |
| SEQ ID 326 | [LR](A)[sP] · [dR](A)[sP] · [dR](C)[sP] · [LR](A)[sP] · [dR](C)[sP] · [LR]([5meC])[sP] · [dR](C)[sP] · [dR](C)[sP] · [dR](T)[sP] · [LR](G)[sP] · [dR](T)[sP] · [dR](G)[sP] · [dR](G)[sP] · [LR](A)[sP] · [dR](T)[sP] · [dR](A)[sP] · [LR](G)[sP] · [LR](G) |
| SEQ ID 327 | [LR](G)[sP] · [dR](G)[sP] · [LR](A)[sP] · [dR](A)[sP] · [LR](A)[sP] · [dR](C)[sP] · [LR](A)[sP] · [dR](C)[sP] · [LR]([5meC])[sP] · [dR](C)[sP] · [dR](T)[sP] · [LR](G)[sP] · [dR](T)[sP] · [dR](G)[sP] · [dR](A)[sP] · [LR](T)[sP] |
| SEQ ID 328 | [LR]([5meC])[sP] · [dR](A)[sP] · [dR](C)[sP] · [LR](A)[sP] · [dR](C)[sP] · [LR](A)[sP] · [dR](A)[sP] · [dR](A)[sP] · [dR](C)[sP] · [LR](A)[sP] · [dR](C)[sP] · [dR](C)[sP] · [dR](C)[sP] · [LR]([5meC])[sP] · [dR](T)[sP] · [dR](G)[sP] · [LR](T)[sP] · [LR](G) |

-continued

| SEQ ID | HELM, 5' - 3' direction |
|---|---|
| SEQ ID 329 | [LR](A)[sP] · [LR]([5meC])[sP] · [dR](A)[sP] · [dR](C)[sP] · [LR](A)[sP] · [dR](C)[sP] · [LR](A)[sP] · [dR](C)[sP] · [LR](A)[sP] · [dR](A)[sP] · [dR](A)[sP] · [dR](C)[sP] · [LR](A)[sP] · [dR](C)[sP] · [dR](C)[sP] · [dR](C)[sP] · [LR]([5meC])[sP] · [LR](T) |
| SEQ ID 330 | [LR]([5meC])[sP] · [LR](G)[sP] · [dR](C)[sP] · [dR](A)[sP] · [dR](C)[sP] · [LR](A)[sP] · [dR](C)[sP] · [dR](A)[sP] · [dR](C)[sP] · [LR](A)[sP] · [dR](C)[sP] · [LR](A)[sP] · [dR](A)[sP] · [dR](A)[sP] · [dR](C)[sP] · [LR](A)[sP] · [LR]([5meC])[sP] · [LR]([5meC] |
| SEQ ID 331 | [LR](A)[sP] · [dR]([5meC])[sP] · [dR](G)[sP] · [LR]([5meC])[sP] · [dR](G)[sP] · [dR](C)[sP] · [dR](A)[sP] · [LR]([5meC])[sP] · [dR](A)[sP] · [LR]([5meC])[sP] · [LR](A)[sP] · [dR](C)[sP] · [LR](A)[sP] · [dR](C)[sP] · [LR](A)[sP] · [dR](A)[sP] · [LR](A)[sP] · [LR]([5meC] |
| SEQ ID 332 | [LR]([5meC])[sP] · [dR](A)[sP] · [dR](C)[sP] · [LR](A)[sP] · [dR](C)[sP] · [LR](G)[sP] · [dR]([5meC])[sP] · [dR](G)[sP] · [dR](C)[sP] · [LR](A)[sP] · [dR](C)[sP] · [dR](A)[sP] · [dR](C)[sP] · [LR](A)[sP] · [dR](C)[sP] · [LR](A)[sP] · [LR]([5meC])[sP] · [LR](A) |
| SEQ ID 333 | [LR](A)[sP] · [dR]([5meC])[sP] · [dR](G)[sP] · [dR](C)[sP] · [LR](A)[sP] · [dR](C)[sP] · [dR](A)[sP] · [dR](C)[sP] · [LR](G)[sP] · [dR]([5meC])[sP] · [dR](G)[sP] · [dR](C)[sP] · [LR](A)[sP] · [dR](C)[sP] · [dR](A)[sP] · [dR](C)[sP] · [LR](A)[sP] · [LR]([5meC] |
| SEQ ID 334 | [LR](G)[sP] · [dR](A)[sP] · [LR](A)[sP] · [dR](A)[sP] · [dR](C)[sP] · [LR](G)[sP] · [dR](C)[sP] · [dR](A)[sP] · [dR](C)[sP] · [LR](A)[sP] · [dR]([5meC])[sP] · [dR](G)[sP] · [dR](C)[sP] · [LR](G)[sP] · [dR](C)[sP] · [dR](A)[sP] · [LR]([5meC]) · [LR](A) |
| SEQ ID 335 | [LR](A)[sP] · [dR](T)[sP] · [dR](T)[sP] · [dR](G)[sP] · [LR](A)[sP] · [LR](A)[sP] · [dR]([5meC])[sP] · [LR](A)[sP] · [dR](G)[sP] · [dR](C)[sP] · [LR](A)[sP] · [dR](C)[sP] · [LR](A)[sP] · [dR](C)[sP] · [LR](G)[sP] · [dR](C)[sP] · [LR](G)[sP] · [LR]([5meC] |
| SEQ ID 336 | [LR](T)[sP] · [LR](T)[sP] · [dR](T)[sP] · [LR](A)[sP] · [dR](T)[sP] · [LR](T)[sP] · [LR](G)[sP] · [dR](A)[sP] · [LR](A)[sP] · [LR](A)[sP] · [LR]([5meC])[sP] · [dR](G)[sP] · [LR]([5meC])[sP] · [LR](A)[sP] · [dR](C)[sP] · [dR](A)[sP] · [LR]([5meC])[sP] · [LR](G) |
| SEQ ID 337 | [LR](A)[sP] · [LR](A)[sP] · [LR]([5meC])[sP] · [dR](T)[sP] · [dR](T)[sP] · [dR](T)[sP] · [LR](A)[sP] · [dR](T)[sP] · [LR](T)[sP] · [LR](G)[sP] · [LR](A)[sP] · [dR](A)[sP] · [LR](A)[sP] · [LR]([5meC])[sP] · [dR](G)[sP] · [LR]([5meC])[sP] · [LR](A)[sP] · [LR]([5meC] |
| SEQ ID 338 | [LR](A)[sP] · [LR]([5meC])[sP] · [LR](A)[sP] · [dR](A)[sP] · [dR](A)[sP] · [LR]([5meC])[sP] · [LR](T)[sP] · [dR](T)[sP] · [LR](T)[sP] · [LR](A)[sP] · [dR](T)[sP] · [LR](T)[sP] · [LR](G)[sP] · [LR](A)[sP] · [dR](A)[sP] · [LR](A)[sP] · [LR]([5meC])[sP] · [LR](G) |
| SEQ ID 339 | [LR](T)[sP] · [LR](G)[sP] · [dR](T)[sP] · [dR](A)[sP] · [LR]([5meC])[sP] · [LR](A)[sP] · [dR](A)[sP] · [LR](A)[sP] · [LR]([5meC])[sP] · [LR](T)[sP] · [dR](T)[sP] · [LR](T)[sP] · [LR](A)[sP] · [LR](T)[sP] · [dR](T)[sP] · [LR](G)[sP] · [LR](A)[sP] · [LR](A) |
| SEQ ID 340 | [LR](A)[sP] · [dR](A)[sP] · [LR](G)[sP] · [LR](T)[sP] · [LR](G)[sP] · [dR](T)[sP] · [LR](A)[sP] · [LR]([5meC])[sP] · [LR](A)[sP] · [dR](A)[sP] · [LR](A)[sP] · [LR]([5meC])[sP] · [LR](T)[sP] · [dR](T)[sP] · [LR](T)[sP] · [dR](A)[sP] · [LR](T)[sP] · [LR](T) |
| SEQ ID 341 | [LR](A)[sP] · [LR](G)[sP] · [dR](A)[sP] · [dR](A)[sP] · [LR](A)[sP] · [LR](G)[sP] · [LR](T)[sP] · [dR](G)[sP] · [LR](T)[sP] · [LR](A)[sP] · [LR]([5meC])[sP] · [dR](A)[sP] · [LR](A)[sP] · [dR](A)[sP] · [LR]([5meC])[sP] · [dR](T)[sP] · [LR](T)[sP] · [LR](T) |
| SEQ ID 342 | [LR](T)[sP] · [LR](T)[sP] · [LR](A)[sP] · [dR](A)[sP] · [LR](G)[sP] · [LR](A)[sP] · [dR](A)[sP] · [LR](A)[sP] · [LR](G)[sP] · [LR](T)[sP] · [dR](G)[sP] · [LR](T)[sP] · [LR](A)[sP] · [LR]([5meC])[sP] · [dR](A)[sP] · [dR](A)[sP] · [LR](A)[sP] · [LR]([5meC] |

Helm Annotation Key:
[LR](G) is a beta-D-oxy-LNA guanine nucleoside,
[LR](T) is a beta-D-oxy-LNA thymine nucleoside,
[LR](A) is a beta-D-oxy-LNA adenine nucleoside,
[LR]([5meC]) is a beta-D-oxy-LNA 5-methyl cystosine nucleoside,
[dR](G) is a DNA guanine nucleoside,
[dR](T) is a DNA thymine nucleoside,
[dR](A) is a DNA adenine nucleoside,
[dR]([C) is a DNA cytosine nucleoside,
[mR](G) is a 2'-O-methyl RNA guanine nucleoside,
[mR](U) is a 2'-O-methyl RNA DNA uracil nucleoside,
[mR](A) is a 2'-O-methyl RNA DNA adenine nucleoside,
[mR]([C) is a 2'-O-methyl RNA DNA cytosine nucleoside,
[sP] is a phosphorothioate internucleoside linkage.

SEQUENCE LISTING (3949 sequences)

SEQ ID NO: 1 - DNA, 2346 bp, Homo sapiens
attctccaatcacatgatccctagaaatggggtgtggggcgagaggaagcagggaggagagtgatttgagtagaaaagaaacacagcattccaggctggccccacctctatattgataagtagccaatgggagcgggtagccctgatccctggccaatggaaactgaggtaggcgggtcatcgcgctggggtctgtagtctgagcgctacccggttgctgctgcccaaggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaa

SEQ ID NO: 2 - DNA, 36 bp, Homo sapiens
tagccctgatccctggccaatggaaactgaggtagg

SEQ ID NO: 3 - DNA, 16 bp, Artificial
  source: /note="Oligonucleotide base motif""
cctgcttcctctcgcc

SEQ ID NO: 4 - DNA, 16 bp, Artificial
  source: /note="Oligonucleotide base motif""
ccctgcttcctctcgc

SEQ ID NO: 5 - DNA, 16 bp, Artificial
  source: /note="Oligonucleotide base motif"
tccctgcttcctctcg

SEQ ID NO: 6 - DNA, 16 bp, Artificial
  source: /note="Oligonucleotide base motif"
ctccctgcttcctctc

SEQ ID NO: 7 - DNA, 16 bp, Artificial
  source: /note="Oligonucleotide base motif"
cctccctgcttcctct

SEQ ID NO: 8 - DNA, 16 bp, Artificial
  source: /note="Oligonucleotide base motif"
tcctccctgcttcctc

SEQ ID NO: 9 - DNA, 16 bp, Artificial
  source: /note="Oligonucleotide base motif"
ctcctccctgcttcct

SEQ ID NO: 10 - DNA, 16 bp, Artificial
  source: /note="Oligonucleotide base motif"
tctcctccctgcttcc

SEQ ID NO: 11 - DNA, 16 bp, Artificial
  source: /note="Oligonucleotide base motif"
ctctcctccctgcttc

SEQ ID NO: 12 - DNA, 16 bp, Artificial
  source: /note="Oligonucleotide base motif"
actctcctccctgctt

SEQ ID NO: 13 - DNA, 16 bp, Artificial
  source: /note="Oligonucleotide base motif"
cactctcctccctgct

SEQ ID NO: 14 - DNA, 16 bp, Artificial
  source: /note="Oligonucleotide base motif"
tcactctcctccctgc

SEQ ID NO: 15 - DNA, 16 bp, Artificial
  source: /note="Oligonucleotide base motif"
atcactctcctccctg

SEQ ID NO: 16 - DNA, 16 bp, Artificial
  source: /note="Oligonucleotide base motif"
aatcactctcctccct

SEQ ID NO: 17 - DNA, 16 bp, Artificial
  source: /note="Oligonucleotide base motif"
aaatcactctcctccc

SEQ ID NO: 18 - DNA, 16 bp, Artificial
  source: /note="Oligonucleotide base motif"
caaatcactctcctcc

SEQ ID NO: 19 - DNA, 16 bp, Artificial
  source: /note="Oligonucleotide base motif"
tcaaatcactctcctc

SEQ ID NO: 20 - DNA, 16 bp, Artificial
  source: /note="Oligonucleotide base motif"
ctcaaatcactctcct

SEQ ID NO: 21 - DNA, 16 bp, Artificial
  source: /note="Oligonucleotide base motif"
actcaaatcactctcc

SEQ ID NO: 22 - DNA, 16 bp, Artificial
  source: /note="Oligonucleotide base motif"
tactcaaatcactctc

SEQ ID NO: 23 - DNA, 16 bp, Artificial
  source: /note="Oligonucleotide base motif"
ctactcaaatcactct

SEQ ID NO: 24 - DNA, 16 bp, Artificial
  source: /note="Oligonucleotide base motif"
tctactcaaatcactc

SEQ ID NO: 25 - DNA, 16 bp, Artificial
  source: /note="Oligonucleotide base motif"
ttctactcaaatcact

SEQ ID NO: 26 - DNA, 16 bp, Artificial
  source: /note="Oligonucleotide base motif"
tttctactcaaatcac

SEQ ID NO: 27 - DNA, 16 bp, Artificial
  source: /note="Oligonucleotide base motif"
ttttctactcaaatca

SEQ ID NO: 28 - DNA, 16 bp, Artificial
  source: /note="Oligonucleotide base motif"
cttttctactcaaatc

SEQ ID NO: 29 - DNA, 16 bp, Artificial
  source: /note="Oligonucleotide base motif"
tcttttctactcaaat

SEQ ID NO: 30 - DNA, 16 bp, Artificial
  source: /note="Oligonucleotide base motif"
ttcttttctactcaaa

SEQ ID NO: 31 - DNA, 16 bp, Artificial
  source: /note="Oligonucleotide base motif"
tttcttttctactcaa

SEQ ID NO: 32 - DNA, 16 bp, Artificial
  source: /note="Oligonucleotide base motif"
gtttcttttctactca

SEQ ID NO: 33 - DNA, 16 bp, Artificial
  source: /note="Oligonucleotide base motif"
tgtttcttttctactc

SEQ ID NO: 34 - DNA, 16 bp, Artificial
  source: /note="Oligonucleotide base motif"
gtgtttcttttctact

SEQ ID NO: 35 - DNA, 16 bp, Artificial
  source: /note="Oligonucleotide base motif"
tgtgtttcttttctac

SEQ ID NO: 36 - DNA, 16 bp, Artificial
  source: /note="Oligonucleotide base motif"
ctgtgtttcttttcta

SEQ ID NO: 37 - DNA, 16 bp, Artificial
  source: /note="Oligonucleotide base motif"
gctgtgtttcttttct

SEQ ID NO: 38 - DNA, 16 bp, Artificial
  source: /note="Oligonucleotide base motif"
tgctgtgtttcttttc

SEQ ID NO: 39 - DNA, 16 bp, Artificial
  source: /note="Oligonucleotide base motif"
atgctgtgtttctttt

SEQ ID NO: 40 - DNA, 16 bp, Artificial
  source: /note="Oligonucleotide base motif"
aatgctgtgtttcttt

SEQ ID NO: 41 - DNA, 16 bp, Artificial
  source: /note="Oligonucleotide base motif"
gaatgctgtgtttctt

SEQ ID NO: 42 - DNA, 16 bp, Artificial
  source: /note="Oligonucleotide base motif"
ggaatgctgtgtttct

SEQ ID NO: 43 - DNA, 16 bp, Artificial
  source: /note="Oligonucleotide base motif"
tggaatgctgtgtttc

SEQ ID NO: 44 - DNA, 16 bp, Artificial
  source: /note="Oligonucleotide base motif"
ctggaatgctgtgttt

SEQ ID NO: 45 - DNA, 16 bp, Artificial
  source: /note="Oligonucleotide base motif"
cctggaatgctgtgtt

SEQ ID NO: 46 - DNA, 16 bp, Artificial
  source: /note="Oligonucleotide base motif"
gcctggaatgctgtgt

SEQ ID NO: 47 - DNA, 16 bp, Artificial
  source: /note="Oligonucleotide base motif"
agcctggaatgctgtg

SEQ ID NO: 48 - DNA, 16 bp, Artificial
  source: /note="Oligonucleotide base motif"
cagcctggaatgctgt

SEQ ID NO: 49 - DNA, 16 bp, Artificial
  source: /note="Oligonucleotide base motif"
ccagcctggaatgctg

SEQ ID NO: 50 - DNA, 16 bp, Artificial
  source: /note="Oligonucleotide base motif"
gccagcctggaatgct

SEQ ID NO: 51 - DNA, 16 bp, Artificial
  source: /note="Oligonucleotide base motif"
ggccagcctggaatgc

SEQ ID NO: 52 - DNA, 16 bp, Artificial
  source: /note="Oligonucleotide base motif"
gggccagcctggaatg

SEQ ID NO: 53 - DNA, 16 bp, Artificial
  source: /note="Oligonucleotide base motif"
ggggccagcctggaat

SEQ ID NO: 54 - DNA, 16 bp, Artificial
  source: /note="Oligonucleotide base motif"
tggggccagcctggaa

SEQ ID NO: 55 - DNA, 16 bp, Artificial
  source: /note="Oligonucleotide base motif"
gtggggccagcctgga

SEQ ID NO: 56 - DNA, 16 bp, Artificial
  source: /note="Oligonucleotide base motif"
ggtggggccagcctgg

SEQ ID NO: 57 - DNA, 16 bp, Artificial
  source: /note="Oligonucleotide base motif"
aggtggggccagcctg

SEQ ID NO: 58 - DNA, 16 bp, Artificial
  source: /note="Oligonucleotide base motif"
gaggtggggccagcct

SEQ ID NO: 59 - DNA, 16 bp, Artificial
  source: /note="Oligonucleotide base motif"
agaggtggggccagcc

SEQ ID NO: 60 - DNA, 16 bp, Artificial
  source: /note="Oligonucleotide base motif"
tagaggtggggccagc

SEQ ID NO: 61 - DNA, 16 bp, Artificial
  source: /note="Oligonucleotide base motif"
atagaggtggggccag

SEQ ID NO: 62 - DNA, 16 bp, Artificial
  source: /note="Oligonucleotide base motif"
tatagaggtggggcca

SEQ ID NO: 63 - DNA, 16 bp, Artificial
  source: /note="Oligonucleotide base motif"
atatagaggtggggcc

SEQ ID NO: 64 - DNA, 16 bp, Artificial
  source: /note="Oligonucleotide base motif"
aatatagaggtggggc

SEQ ID NO: 65 - DNA, 16 bp, Artificial
  source: /note="Oligonucleotide base motif"
caatatagaggtgggg

SEQ ID NO: 66 - DNA, 16 bp, Artificial
  source: /note="Oligonucleotide base motif"
tcaatatagaggtggg

SEQ ID NO: 67 - DNA, 16 bp, Artificial
  source: /note="Oligonucleotide base motif"
atcaatatagaggtgg

SEQ ID NO: 68 - DNA, 16 bp, Artificial
  source: /note="Oligonucleotide base motif"
tatcaatatagaggtg

SEQ ID NO: 69 - DNA, 16 bp, Artificial
  source: /note="Oligonucleotide base motif"
ttatcaatatagaggt

SEQ ID NO: 70 - DNA, 16 bp, Artificial
  source: /note="Oligonucleotide base motif"
cttatcaatatagagg

SEQ ID NO: 71 - DNA, 16 bp, Artificial
  source: /note="Oligonucleotide base motif"
acttatcaatatagag

SEQ ID NO: 72 - DNA, 16 bp, Artificial
  source: /note="Oligonucleotide base motif"
tacttatcaatataga

SEQ ID NO: 73 - DNA, 16 bp, Artificial
  source: /note="Oligonucleotide base motif"
ctacttatcaatatag

SEQ ID NO: 74 - DNA, 16 bp, Artificial
  source: /note="Oligonucleotide base motif"
gctacttatcaatata

SEQ ID NO: 75 - DNA, 16 bp, Artificial
  source: /note="Oligonucleotide base motif"
ggctacttatcaatat

SEQ ID NO: 76 - DNA, 16 bp, Artificial
  source: /note="Oligonucleotide base motif"
tggctacttatcaata

SEQ ID NO: 77 - DNA, 16 bp, Artificial
  source: /note="Oligonucleotide base motif"
ttggctacttatcaat

SEQ ID NO: 78 - DNA, 16 bp, Artificial
  source: /note="Oligonucleotide base motif"
attggctacttatcaa

SEQ ID NO: 79 - DNA, 16 bp, Artificial
  source: /note="Oligonucleotide base motif"
cattggctacttatca

SEQ ID NO: 80 - DNA, 16 bp, Artificial
  source: /note="Oligonucleotide base motif"
ccattggctacttatc

SEQ ID NO: 81 - DNA, 16 bp, Artificial
  source: /note="Oligonucleotide base motif"
cccattggctacttat

SEQ ID NO: 82 - DNA, 16 bp, Artificial
  source: /note="Oligonucleotide base motif"
tcccattggctactta

SEQ ID NO: 83 - DNA, 16 bp, Artificial
  source: /note="Oligonucleotide base motif"
ctcccattggctactt

SEQ ID NO: 84 - DNA, 16 bp, Artificial
  source: /note="Oligonucleotide base motif"
gctcccattggctact

SEQ ID NO: 85 - DNA, 16 bp, Artificial
  source: /note="Oligonucleotide base motif"
cgctcccattggctac

SEQ ID NO: 86 - DNA, 16 bp, Artificial
  source: /note="Oligonucleotide base motif"
ccgctcccattggcta

SEQ ID NO: 87 - DNA, 16 bp, Artificial
  source: /note="Oligonucleotide base motif"
cccgctcccattggct

SEQ ID NO: 88 - DNA, 16 bp, Artificial
  source: /note="Oligonucleotide base motif"
acccgctcccattggc

SEQ ID NO: 89 - DNA, 16 bp, Artificial
  source: /note="Oligonucleotide base motif"
tacccgctcccattgg

SEQ ID NO: 90 - DNA, 16 bp, Artificial
  source: /note="Oligonucleotide base motif"
ctacccgctcccattg

SEQ ID NO: 91 - DNA, 16 bp, Artificial
  source: /note="Oligonucleotide base motif"
gctacccgctcccatt

SEQ ID NO: 92 - DNA, 16 bp, Artificial
  source: /note="Oligonucleotide base motif"
ggctacccgctcccat

SEQ ID NO: 93 - DNA, 16 bp, Artificial
  source: /note="Oligonucleotide base motif"
gggctacccgctccca

SEQ ID NO: 94 - DNA, 16 bp, Artificial
  source: /note="Oligonucleotide base motif"
agggctacccgctccc

SEQ ID NO: 95 - DNA, 16 bp, Artificial
  source: /note="Oligonucleotide base motif"
cagggctacccgctcc

SEQ ID NO: 96 - DNA, 16 bp, Artificial
  source: /note="Oligonucleotide base motif"
tcagggctacccgctc

SEQ ID NO: 97 - DNA, 16 bp, Artificial
  source: /note="Oligonucleotide base motif"
atcagggctacccgct

SEQ ID NO: 98 - DNA, 16 bp, Artificial
  source: /note="Oligonucleotide base motif"
gatcagggctacccgc

SEQ ID NO: 99 - DNA, 16 bp, Artificial
  source: /note="Oligonucleotide base motif"
ggatcagggctacccg

SEQ ID NO: 100 - DNA, 16 bp, Artificial
  source: /note="Oligonucleotide base motif"
gggatcagggctaccc

SEQ ID NO: 101 - DNA, 16 bp, Artificial
  source: /note="Oligonucleotide base motif"
agggatcagggctacc

SEQ ID NO: 102 - DNA, 16 bp, Artificial
  source: /note="Oligonucleotide base motif"
cagggatcagggctac

SEQ ID NO: 103 - DNA, 16 bp, Artificial
  source: /note="Oligonucleotide base motif"
ccagggatcagggcta

SEQ ID NO: 104 - DNA, 16 bp, Artificial
  source: /note="Oligonucleotide base motif"
gccagggatcagggct

SEQ ID NO: 105 - DNA, 16 bp, Artificial
  source: /note="Oligonucleotide base motif"
ggccagggatcagggc

SEQ ID NO: 106 - DNA, 16 bp, Artificial
  source: /note="Oligonucleotide base motif"
tggccagggatcaggg

SEQ ID NO: 107 - DNA, 16 bp, Artificial
  source: /note="Oligonucleotide base motif"
ttggccagggatcagg

SEQ ID NO: 108 - DNA, 16 bp, Artificial
  source: /note="Oligonucleotide base motif"
attggccagggatcag

SEQ ID NO: 109 - DNA, 16 bp, Artificial
  source: /note="Oligonucleotide base motif"
cattggccagggatca

SEQ ID NO: 110 - DNA, 16 bp, Artificial
  source: /note="Oligonucleotide base motif"
ccattggccagggatc

SEQ ID NO: 111 - DNA, 16 bp, Artificial
  source: /note="Oligonucleotide base motif"
tccattggccagggat

SEQ ID NO: 112 - DNA, 16 bp, Artificial
  source: /note="Oligonucleotide base motif"
ttccattggccaggga

SEQ ID NO: 113 - DNA, 16 bp, Artificial
  source: /note="Oligonucleotide base motif"
tttccattggccaggg

SEQ ID NO: 114 - DNA, 16 bp, Artificial
  source: /note="Oligonucleotide base motif"
gtttccattggccagg

SEQ ID NO: 115 - DNA, 16 bp, Artificial
  source: /note="Oligonucleotide base motif"
agtttccattggccag

SEQ ID NO: 116 - DNA, 16 bp, Artificial
  source: /note="Oligonucleotide base motif"
cagtttccattggcca

SEQ ID NO: 117 - DNA, 16 bp, Artificial
  source: /note="Oligonucleotide base motif"
tcagtttccattggcc

SEQ ID NO: 118 - DNA, 16 bp, Artificial
  source: /note="Oligonucleotide base motif"
ctcagtttccattggc

SEQ ID NO: 119 - DNA, 16 bp, Artificial
  source: /note="Oligonucleotide base motif"
cctcagtttccattgg

SEQ ID NO: 120 - DNA, 16 bp, Artificial
  source: /note="Oligonucleotide base motif"
acctcagtttccattg

SEQ ID NO: 121 - DNA, 16 bp, Artificial
  source: /note="Oligonucleotide base motif"
tacctcagtttccatt

SEQ ID NO: 122 - DNA, 16 bp, Artificial
  source: /note="Oligonucleotide base motif"
ctacctcagtttccat

SEQ ID NO: 123 - DNA, 16 bp, Artificial
  source: /note="Oligonucleotide base motif"
cctacctcagtttcca

SEQ ID NO: 124 - DNA, 16 bp, Artificial
  source: /note="Oligonucleotide base motif"
gcctacctcagtttcc

SEQ ID NO: 125 - DNA, 16 bp, Artificial
  source: /note="Oligonucleotide base motif"
cgcctacctcagtttc

SEQ ID NO: 126 - DNA, 16 bp, Artificial
  source: /note="Oligonucleotide base motif"
ccgcctacctcagttt

SEQ ID NO: 127 - DNA, 16 bp, Artificial
  source: /note="Oligonucleotide base motif"
cccgcctacctcagtt

SEQ ID NO: 128 - DNA, 16 bp, Artificial
  source: /note="Oligonucleotide base motif"
acccgcctacctcagt

SEQ ID NO: 129 - DNA, 16 bp, Artificial
  source: /note="Oligonucleotide base motif"
gacccgcctacctcag

SEQ ID NO: 130 - DNA, 16 bp, Artificial
  source: /note="Oligonucleotide base motif"
tgacccgcctacctca

SEQ ID NO: 131 - DNA, 16 bp, Artificial
  source: /note="Oligonucleotide base motif"
atgacccgcctacctc

SEQ ID NO: 132 - DNA, 16 bp, Artificial
  source: /note="Oligonucleotide base motif"
gatgacccgcctacct

SEQ ID NO: 133 - DNA, 16 bp, Artificial
  source: /note="Oligonucleotide base motif"
cgatgacccgcctacc

SEQ ID NO: 134 - DNA, 16 bp, Artificial
  source: /note="Oligonucleotide base motif"
gcgatgacccgcctac

SEQ ID NO: 135 - DNA, 16 bp, Artificial
  source: /note="Oligonucleotide base motif"
cgcgatgacccgccta

SEQ ID NO: 136 - DNA, 16 bp, Artificial
  source: /note="Oligonucleotide base motif"
gcgcgatgacccgcct

SEQ ID NO: 137 - DNA, 16 bp, Artificial
  source: /note="Oligonucleotide base motif"
agcgcgatgacccgcc

SEQ ID NO: 138 - DNA, 16 bp, Artificial
  source: /note="Oligonucleotide base motif"
cagcgcgatgacccgc

SEQ ID NO: 139 - DNA, 16 bp, Artificial
  source: /note="Oligonucleotide base motif"
ccagcgcgatgacccg

SEQ ID NO: 140 - DNA, 16 bp, Artificial
  source: /note="Oligonucleotide base motif"
cccagcgcgatgaccc

SEQ ID NO: 141 - DNA, 16 bp, Artificial
  source: /note="Oligonucleotide base motif"
ccccagcgcgatgacc

SEQ ID NO: 142 - DNA, 16 bp, Artificial
  source: /note="Oligonucleotide base motif"
accccagcgcgatgac

SEQ ID NO: 143 - DNA, 16 bp, Artificial
  source: /note="Oligonucleotide base motif"
gaccccagcgcgatga

SEQ ID NO: 144 - DNA, 16 bp, Artificial
  source: /note="Oligonucleotide base motif"
agaccccagcgcgatg

SEQ ID NO: 145 - DNA, 16 bp, Artificial
  source: /note="Oligonucleotide base motif"
cagaccccagcgcgat

SEQ ID NO: 146 - DNA, 16 bp, Artificial
  source: /note="Oligonucleotide base motif"
acagaccccagcgcga

SEQ ID NO: 147 - DNA, 16 bp, Artificial
  source: /note="Oligonucleotide base motif"
tacagaccccagcgcg

SEQ ID NO: 148 - DNA, 16 bp, Artificial
  source: /note="Oligonucleotide base motif"
ctacagaccccagcgc

SEQ ID NO: 149 - DNA, 16 bp, Artificial
  source: /note="Oligonucleotide base motif"
actacagaccccagcg

SEQ ID NO: 150 - DNA, 16 bp, Artificial
  source: /note="Oligonucleotide base motif"
gactacagaccccagc

SEQ ID NO: 151 - DNA, 16 bp, Artificial
  source: /note="Oligonucleotide base motif"
agactacagaccccag

SEQ ID NO: 152 - DNA, 16 bp, Artificial
  source: /note="Oligonucleotide base motif"
cagactacagacccca

SEQ ID NO: 153 - DNA, 16 bp, Artificial
  source: /note="Oligonucleotide base motif"
tcagactacagacccc

SEQ ID NO: 154 - DNA, 16 bp, Artificial
  source: /note="Oligonucleotide base motif"
ctcagactacagaccc

SEQ ID NO: 155 - DNA, 16 bp, Artificial
  source: /note="Oligonucleotide base motif"
gctcagactacagacc

SEQ ID NO: 156 - DNA, 16 bp, Artificial
  source: /note="Oligonucleotide base motif"
cgctcagactacagac

SEQ ID NO: 157 - DNA, 16 bp, Artificial
  source: /note="Oligonucleotide base motif"
gcgctcagactacaga

SEQ ID NO: 158 - DNA, 16 bp, Artificial
  source: /note="Oligonucleotide base motif"
agcgctcagactacag

SEQ ID NO: 159 - DNA, 16 bp, Artificial
  source: /note="Oligonucleotide base motif"
tagcgctcagactaca

SEQ ID NO: 160 - DNA, 16 bp, Artificial
  source: /note="Oligonucleotide base motif"
gtagcgctcagactac

SEQ ID NO: 161 - DNA, 16 bp, Artificial
  source: /note="Oligonucleotide base motif"
ggtagcgctcagacta

SEQ ID NO: 162 - DNA, 16 bp, Artificial
  source: /note="Oligonucleotide base motif"
gggtagcgctcagact

SEQ ID NO: 163 - DNA, 16 bp, Artificial
  source: /note="Oligonucleotide base motif"
cgggtagcgctcagac

SEQ ID NO: 164 - DNA, 16 bp, Artificial
  source: /note="Oligonucleotide base motif"
ccgggtagcgctcaga

SEQ ID NO: 165 - DNA, 16 bp, Artificial
  source: /note="Oligonucleotide base motif"
accgggtagcgctcag

SEQ ID NO: 166 - DNA, 16 bp, Artificial
  source: /note="Oligonucleotide base motif"
aaccgggtagcgctca

SEQ ID NO: 167 - DNA, 16 bp, Artificial
  source: /note="Oligonucleotide base motif"
caaccgggtagcgctc

SEQ ID NO: 168 - DNA, 16 bp, Artificial
  source: /note="Oligonucleotide base motif"
gcaaccgggtagcgct

SEQ ID NO: 169 - DNA, 16 bp, Artificial
  source: /note="Oligonucleotide base motif"
agcaaccgggtagcgc

SEQ ID NO: 170 - DNA, 16 bp, Artificial
  source: /note="Oligonucleotide base motif"
cagcaaccgggtagcg

SEQ ID NO: 171 - DNA, 16 bp, Artificial
  source: /note="Oligonucleotide base motif"
gcagcaaccgggtagc

SEQ ID NO: 172 - DNA, 16 bp, Artificial
  source: /note="Oligonucleotide base motif"
agcagcaaccgggtag

SEQ ID NO: 173 - DNA, 16 bp, Artificial
  source: /note="Oligonucleotide base motif"
cagcagcaaccgggta

SEQ ID NO: 174 - DNA, 16 bp, Artificial
  source: /note="Oligonucleotide base motif"
gcagcagcaaccgggt

SEQ ID NO: 175 - DNA, 16 bp, Artificial
  source: /note="Oligonucleotide base motif"
ggcagcagcaaccggg

SEQ ID NO: 176 - DNA, 16 bp, Artificial
  source: /note="Oligonucleotide base motif"
gggcagcagcaaccgg

SEQ ID NO: 177 - DNA, 16 bp, Artificial
  source: /note="Oligonucleotide base motif"
tgggcagcagcaaccg

SEQ ID NO: 178 - DNA, 16 bp, Artificial
  source: /note="Oligonucleotide base motif"
ttgggcagcagcaacc

SEQ ID NO: 179 - DNA, 16 bp, Artificial
  source: /note="Oligonucleotide base motif"
cttgggcagcagcaac

SEQ ID NO: 180 - DNA, 16 bp, Artificial
  source: /note="Oligonucleotide base motif"
ccttgggcagcagcaa

SEQ ID NO: 181 - DNA, 16 bp, Artificial
  source: /note="Oligonucleotide base motif"
tccttgggcagcagca

SEQ ID NO: 182 - DNA, 16 bp, Artificial
  source: /note="Oligonucleotide base motif"
gtccttgggcagcagc

SEQ ID NO: 183 - DNA, 16 bp, Artificial
  source: /note="Oligonucleotide base motif"
ggtccttgggcagcag

SEQ ID NO: 184 - DNA, 16 bp, Artificial
  source: /note="Oligonucleotide base motif"
cggtccttgggcagca

SEQ ID NO: 185 - DNA, 16 bp, Artificial
  source: /note="Oligonucleotide base motif"
gcggtccttgggcagc

SEQ ID NO: 186 - DNA, 16 bp, Artificial
  source: /note="Oligonucleotide base motif"
cgcggtccttgggcag

SEQ ID NO: 187 - DNA, 16 bp, Artificial
  source: /note="Oligonucleotide base motif"
ccgcggtccttgggca

SEQ ID NO: 188 - DNA, 16 bp, Artificial
  source: /note="Oligonucleotide base motif"
tccgcggtccttgggc

SEQ ID NO: 189 - DNA, 16 bp, Artificial
  source: /note="Oligonucleotide base motif"
ctccgcggtccttggg

SEQ ID NO: 190 - DNA, 16 bp, Artificial
  source: /note="Oligonucleotide base motif"
actccgcggtccttgg

SEQ ID NO: 191 - DNA, 16 bp, Artificial
  source: /note="Oligonucleotide base motif"
gactccgcggtccttg

SEQ ID NO: 192 - DNA, 16 bp, Artificial
  source: /note="Oligonucleotide base motif"
cgactccgcggtcctt

SEQ ID NO: 193 - DNA, 16 bp, Artificial
  source: /note="Oligonucleotide base motif"
ccgactccgcggtcct

SEQ ID NO: 194 - DNA, 16 bp, Artificial
  source: /note="Oligonucleotide base motif"
tccgactccgcggtcc

SEQ ID NO: 195 - DNA, 16 bp, Artificial
  source: /note="Oligonucleotide base motif"
gtccgactccgcggtc

SEQ ID NO: 196 - DNA, 16 bp, Artificial
  source: /note="Oligonucleotide base motif"
cgtccgactccgcggt

SEQ ID NO: 197 - DNA, 16 bp, Artificial
  source: /note="Oligonucleotide base motif"
gcgtccgactccgcgg

SEQ ID NO: 198 - DNA, 16 bp, Artificial
  source: /note="Oligonucleotide base motif"
tgcgtccgactccgcg

SEQ ID NO: 199 - DNA, 16 bp, Artificial
  source: /note="Oligonucleotide base motif"
ctgcgtccgactccgc

SEQ ID NO: 200 - DNA, 16 bp, Artificial
  source: /note="Oligonucleotide base motif"
cctgcgtccgactccg

SEQ ID NO: 201 - DNA, 16 bp, Artificial
  source: /note="Oligonucleotide base motif"
gcctgcgtccgactcc

SEQ ID NO: 202 - DNA, 16 bp, Artificial
  source: /note="Oligonucleotide base motif"
tgcctgcgtccgactc

SEQ ID NO: 203 - DNA, 16 bp, Artificial
  source: /note="Oligonucleotide base motif"
ctgcctgcgtccgact

SEQ ID NO: 204 - DNA, 16 bp, Artificial
  source: /note="Oligonucleotide base motif"
tctgcctgcgtccgac

SEQ ID NO: 205 - DNA, 16 bp, Artificial
  source: /note="Oligonucleotide base motif"
gtctgcctgcgtccga

SEQ ID NO: 206 - DNA, 16 bp, Artificial
  source: /note="Oligonucleotide base motif"
ggtctgcctgcgtccg

SEQ ID NO: 207 - DNA, 18 bp, Artificial
  source: /note="Oligonucleotide base motif"
gctcccattggctactta

SEQ ID NO: 208 - DNA, 18 bp, Artificial
  source: /note="Oligonucleotide base motif"
cgctcccattggctactt

SEQ ID NO: 209 - DNA, 18 bp, Artificial
  source: /note="Oligonucleotide base motif"
ccgctcccattggctact

SEQ ID NO: 210 - DNA, 18 bp, Artificial
  source: /note="Oligonucleotide base motif"
cccgctcccattggctac

SEQ ID NO: 211 - DNA, 18 bp, Artificial
  source: /note="Oligonucleotide base motif"
acccgctcccattggcta

SEQ ID NO: 212 - DNA, 18 bp, Artificial
  source: /note="Oligonucleotide base motif"
tacccgctcccattggct

SEQ ID NO: 213 - DNA, 18 bp, Artificial
  source: /note="Oligonucleotide base motif"
ctacccgctcccattggc

SEQ ID NO: 214 - DNA, 18 bp, Artificial
  source: /note="Oligonucleotide base motif"
gctacccgctcccattgg

SEQ ID NO: 215 - DNA, 18 bp, Artificial
  source: /note="Oligonucleotide base motif"
ggctacccgctcccattg

SEQ ID NO: 216 - DNA, 18 bp, Artificial
  source: /note="Oligonucleotide base motif"
gggctacccgctcccatt

SEQ ID NO: 217 - DNA, 18 bp, Artificial
  source: /note="Oligonucleotide base motif"
agggctacccgctcccat

SEQ ID NO: 218 - DNA, 18 bp, Artificial
  source: /note="Oligonucleotide base motif"
cagggctacccgctccca

SEQ ID NO: 219 - DNA, 18 bp, Artificial
  source: /note="Oligonucleotide base motif"
tcagggctacccgctccc

SEQ ID NO: 220 - DNA, 18 bp, Artificial
  source: /note="Oligonucleotide base motif"
atcagggctacccgctcc

SEQ ID NO: 221 - DNA, 18 bp, Artificial
  source: /note="Oligonucleotide base motif"
gatcagggctacccgctc

SEQ ID NO: 222 - DNA, 18 bp, Artificial
  source: /note="Oligonucleotide base motif"
ggatcagggctacccgct

SEQ ID NO: 223 - DNA, 18 bp, Artificial
  source: /note="Oligonucleotide base motif"
gggatcagggctacccgc

SEQ ID NO: 224 - DNA, 18 bp, Artificial
  source: /note="Oligonucleotide base motif"
agggatcagggctacccg

SEQ ID NO: 225 - DNA, 18 bp, Artificial
  source: /note="Oligonucleotide base motif"
cagggatcagggctaccc

SEQ ID NO: 226 - DNA, 18 bp, Artificial
  source: /note="Oligonucleotide base motif"
ccagggatcagggctacc

SEQ ID NO: 227 - DNA, 18 bp, Artificial
  source: /note="Oligonucleotide base motif"
gccagggatcagggctac

SEQ ID NO: 228 - DNA, 18 bp, Artificial
  source: /note="Oligonucleotide base motif"
ggccagggatcagggcta

SEQ ID NO: 229 - DNA, 18 bp, Artificial
  source: /note="Oligonucleotide base motif"
tggccagggatcagggct

SEQ ID NO: 230 - DNA, 18 bp, Artificial
  source: /note="Oligonucleotide base motif"
ttggccagggatcagggc

SEQ ID NO: 231 - DNA, 18 bp, Artificial
  source: /note="Oligonucleotide base motif"
attggccagggatcaggg

SEQ ID NO: 232 - DNA, 18 bp, Artificial
  source: /note="Oligonucleotide base motif"
cattggccagggatcagg

SEQ ID NO: 233 - DNA, 18 bp, Artificial
  source: /note="Oligonucleotide base motif"
ccattggccagggatcag

SEQ ID NO: 234 - DNA, 18 bp, Artificial
  source: /note="Oligonucleotide base motif"
tccattggccagggatca

SEQ ID NO: 235 - DNA, 18 bp, Artificial
  source: /note="Oligonucleotide base motif"
ttccattggccagggatc

SEQ ID NO: 236 - DNA, 18 bp, Artificial
  source: /note="Oligonucleotide base motif"
tttccattggccagggat

SEQ ID NO: 237 - DNA, 18 bp, Artificial
  source: /note="Oligonucleotide base motif"
gtttccattggccaggga

SEQ ID NO: 238 - DNA, 18 bp, Artificial
  source: /note="Oligonucleotide base motif"
agtttccattggccaggg

SEQ ID NO: 239 - DNA, 18 bp, Artificial
  source: /note="Oligonucleotide base motif"
cagtttccattggccagg

SEQ ID NO: 240 - DNA, 18 bp, Artificial
  source: /note="Oligonucleotide base motif"
tcagtttccattggccag

SEQ ID NO: 241 - DNA, 18 bp, Artificial
  source: /note="Oligonucleotide base motif"
ctcagtttccattggcca

SEQ ID NO: 242 - DNA, 18 bp, Artificial
  source: /note="Oligonucleotide base motif"
cctcagtttccattggcc

SEQ ID NO: 243 - DNA, 18 bp, Artificial
  source: /note="Oligonucleotide base motif"
acctcagtttccattggc

SEQ ID NO: 244 - DNA, 18 bp, Artificial
  source: /note="Oligonucleotide base motif"
tacctcagtttccattgg

SEQ ID NO: 245 - DNA, 18 bp, Artificial
  source: /note="Oligonucleotide base motif"
ctacctcagtttccattg

SEQ ID NO: 246 - DNA, 18 bp, Artificial
  source: /note="Oligonucleotide base motif"
cctacctcagtttccatt

SEQ ID NO: 247 - DNA, 18 bp, Artificial
  source: /note="Oligonucleotide base motif"
tgcagagtcttcagtact

SEQ ID NO: 248 - DNA, 18 bp, Artificial
  source: /note="Oligonucleotide base motif"
ggctgcagagtcttcagt

SEQ ID NO: 249 - DNA, 18 bp, Artificial
  source: /note="Oligonucleotide base motif"
gagggctgcagagtcttc

SEQ ID NO: 250 - DNA, 18 bp, Artificial
  source: /note="Oligonucleotide base motif"
cccgagggctgcagagtc

SEQ ID NO: 251 - DNA, 18 bp, Artificial
  source: /note="Oligonucleotide base motif"
ggtcccgagggctgcaga

SEQ ID NO: 252 - DNA, 18 bp, Artificial
  source: /note="Oligonucleotide base motif"
tggggtcccgagggctgc

SEQ ID NO: 253 - DNA, 18 bp, Artificial
  source: /note="Oligonucleotide base motif"
gagtggggtcccgagggc

SEQ ID NO: 254 - DNA, 18 bp, Artificial
  source: /note="Oligonucleotide base motif"
tccgagtggggtcccgag

SEQ ID NO: 255 - DNA, 18 bp, Artificial
  source: /note="Oligonucleotide base motif"
ccctccgagtggggtccc

SEQ ID NO: 256 - DNA, 18 bp, Artificial
  source: /note="Oligonucleotide base motif"
gcaccctccgagtggggt

SEQ ID NO: 257 - DNA, 18 bp, Artificial
  source: /note="Oligonucleotide base motif"
agggcaccctccgagtgg

SEQ ID NO: 258 - DNA, 18 bp, Artificial
  source: /note="Oligonucleotide base motif"
cagagggcaccctccgag

SEQ ID NO: 259 - DNA, 18 bp, Artificial
  source: /note="Oligonucleotide base motif"
gagcagagggcaccctcc

SEQ ID NO: 260 - DNA, 18 bp, Artificial
  source: /note="Oligonucleotide base motif"
cctgagcagagggcaccc

SEQ ID NO: 261 - DNA, 18 bp, Artificial
  source: /note="Oligonucleotide base motif"
aggcctgagcagagggca

SEQ ID NO: 262 - DNA, 18 bp, Artificial
  source: /note="Oligonucleotide base motif"
gggaggcctgagcagagg

SEQ ID NO: 263 - DNA, 18 bp, Artificial
  source: /note="Oligonucleotide base motif"
ctagggaggcctgagcag

SEQ ID NO: 264 - DNA, 18 bp, Artificial
  source: /note="Oligonucleotide base motif"
gtgctagggaggcctgag

SEQ ID NO: 265 - DNA, 18 bp, Artificial
  source: /note="Oligonucleotide base motif"
gaggtgctagggaggcct

SEQ ID NO: 266 - DNA, 18 bp, Artificial
  source: /note="Oligonucleotide base motif"
ggggaggtgctagggagg

SEQ ID NO: 267 - DNA, 18 bp, Artificial
  source: /note="Oligonucleotide base motif"
tagggggaggtgctaggg

SEQ ID NO: 268 - DNA, 18 bp, Artificial
  source: /note="Oligonucleotide base motif"
ggttagggggaggtgcta

SEQ ID NO: 269 - DNA, 18 bp, Artificial
  source: /note="Oligonucleotide base motif"
tttggttagggggaggtg

SEQ ID NO: 270 - DNA, 18 bp, Artificial
  source: /note="Oligonucleotide base motif"
gaatttggttagggggag

SEQ ID NO: 271 - DNA, 18 bp, Artificial
  source: /note="Oligonucleotide base motif"
ggagaatttggttagggg

SEQ ID NO: 272 - DNA, 18 bp, Artificial
  source: /note="Oligonucleotide base motif"
cagggagaatttggttag

SEQ ID NO: 273 - DNA, 18 bp, Artificial
  source: /note="Oligonucleotide base motif"
gtccagggagaatttggt

SEQ ID NO: 274 - DNA, 18 bp, Artificial
  source: /note="Oligonucleotide base motif"
ggggtccagggagaattt

SEQ ID NO: 275 - DNA, 18 bp, Artificial
  source: /note="Oligonucleotide base motif"
aatggggtccagggagaa

SEQ ID NO: 276 - DNA, 18 bp, Artificial
  source: /note="Oligonucleotide base motif"
cagaatggggtccaggga

SEQ ID NO: 277 - DNA, 18 bp, Artificial
  source: /note="Oligonucleotide base motif"
gctcagaatggggtccag

SEQ ID NO: 278 - DNA, 18 bp, Artificial
  source: /note="Oligonucleotide base motif"
ggagctcagaatggggtc

SEQ ID NO: 279 - DNA, 18 bp, Artificial
  source: /note="Oligonucleotide base motif"
tggggagctcagaatggg

SEQ ID NO: 280 - DNA, 18 bp, Artificial
  source: /note="Oligonucleotide base motif"
tgatggggagctcagaat

SEQ ID NO: 281 - DNA, 18 bp, Artificial
  source: /note="Oligonucleotide base motif"
tggtgatggggagctcag

SEQ ID NO: 282 - DNA, 18 bp, Artificial
  source: /note="Oligonucleotide base motif"
ccatggtgatggggagct

SEQ ID NO: 283 - DNA, 18 bp, Artificial
  source: /note="Oligonucleotide base motif"
ctcccatggtgatgggga

SEQ ID NO: 284 - DNA, 18 bp, Artificial
  source: /note="Oligonucleotide base motif"
cacctcccatggtgatgg

SEQ ID NO: 285 - DNA, 18 bp, Artificial
  source: /note="Oligonucleotide base motif"
ccccacctcccatggtga

SEQ ID NO: 286 - DNA, 18 bp, Artificial
  source: /note="Oligonucleotide base motif"
aggccccacctcccatgg

SEQ ID NO: 287 - DNA, 18 bp, Artificial
  source: /note="Oligonucleotide base motif"
ttgaggccccacctccca

SEQ ID NO: 288 - DNA, 18 bp, Artificial
  source: /note="Oligonucleotide base motif"
agattgaggccccacctc

SEQ ID NO: 289 - DNA, 18 bp, Artificial
  source: /note="Oligonucleotide base motif"
cttagattgaggccccac

SEQ ID NO: 290 - DNA, 18 bp, Artificial
  source: /note="Oligonucleotide base motif"
ggccttagattgaggccc

SEQ ID NO: 291 - DNA, 18 bp, Artificial
  source: /note="Oligonucleotide base motif"
gaaggccttagattgagg

SEQ ID NO: 292 - DNA, 18 bp, Artificial
  source: /note="Oligonucleotide base motif"
agggaaggccttagattg

SEQ ID NO: 293 - DNA, 18 bp, Artificial
  source: /note="Oligonucleotide base motif"
gacagggaaggccttaga

SEQ ID NO: 294 - DNA, 18 bp, Artificial
  source: /note="Oligonucleotide base motif"
tctgacagggaaggcctt

SEQ ID NO: 295 - DNA, 18 bp, Artificial
  source: /note="Oligonucleotide base motif"
ccttctgacagggaaggc

SEQ ID NO: 296 - DNA, 18 bp, Artificial
  source: /note="Oligonucleotide base motif"
cccccttctgacagggaa

SEQ ID NO: 297 - DNA, 18 bp, Artificial
  source: /note="Oligonucleotide base motif"
caacccccttctgacagg

SEQ ID NO: 298 - DNA, 18 bp, Artificial
  source: /note="Oligonucleotide base motif"
ccacaacccccttctgac

SEQ ID NO: 299 - DNA, 18 bp, Artificial
  source: /note="Oligonucleotide base motif"
ttgccacaacccccttct

SEQ ID NO: 300 - DNA, 18 bp, Artificial
  source: /note="Oligonucleotide base motif"
cttttgccacaaccccct

SEQ ID NO: 301 - DNA, 18 bp, Artificial
  source: /note="Oligonucleotide base motif"
tggcttttgccacaaccc

SEQ ID NO: 302 - DNA, 18 bp, Artificial
  source: /note="Oligonucleotide base motif"
atgtggcttttgccacaa

SEQ ID NO: 303 - DNA, 18 bp, Artificial
  source: /note="Oligonucleotide base motif"
gtaatgtggcttttgcca

SEQ ID NO: 304 - DNA, 18 bp, Artificial
  source: /note="Oligonucleotide base motif"
cttgtaatgtggcttttg

SEQ ID NO: 305 - DNA, 18 bp, Artificial
  source: /note="Oligonucleotide base motif"
cagcttgtaatgtggctt

SEQ ID NO: 306 - DNA, 18 bp, Artificial
  source: /note="Oligonucleotide base motif"
tggcagcttgtaatgtgg

SEQ ID NO: 307 - DNA, 18 bp, Artificial
  source: /note="Oligonucleotide base motif"
ggatggcagcttgtaatg

SEQ ID NO: 308 - DNA, 18 bp, Artificial
  source: /note="Oligonucleotide base motif"
aggggatggcagcttgta

SEQ ID NO: 309 - DNA, 18 bp, Artificial
  source: /note="Oligonucleotide base motif"
gggaggggatggcagctt

SEQ ID NO: 310 - DNA, 18 bp, Artificial
  source: /note="Oligonucleotide base motif"
acggggaggggatggcag

SEQ ID NO: 311 - DNA, 18 bp, Artificial
  source: /note="Oligonucleotide base motif"
gaaacggggaggggatgg

SEQ ID NO: 312 - DNA, 18 bp, Artificial
  source: /note="Oligonucleotide base motif"
actgaaacggggagggga

SEQ ID NO: 313 - DNA, 18 bp, Artificial
  source: /note="Oligonucleotide base motif"
tccactgaaacggggagg

SEQ ID NO: 314 - DNA, 18 bp, Artificial
  source: /note="Oligonucleotide base motif"
gggtccactgaaacgggg

SEQ ID NO: 315 - DNA, 18 bp, Artificial
  source: /note="Oligonucleotide base motif"
acagggtccactgaaacg

SEQ ID NO: 316 - DNA, 18 bp, Artificial
  source: /note="Oligonucleotide base motif"
gccacagggtccactgaa

SEQ ID NO: 317 - DNA, 18 bp, Artificial
  source: /note="Oligonucleotide base motif"
ctggccacagggtccact

SEQ ID NO: 318 - DNA, 18 bp, Artificial
  source: /note="Oligonucleotide base motif"
cacctggccacagggtcc

SEQ ID NO: 319 - DNA, 18 bp, Artificial
  source: /note="Oligonucleotide base motif"
aagcacctggccacaggg

SEQ ID NO: 320 - DNA, 18 bp, Artificial
  source: /note="Oligonucleotide base motif"
gaaaagcacctggccaca

SEQ ID NO: 321 - DNA, 18 bp, Artificial
  source: /note="Oligonucleotide base motif"
agggaaaagcacctggcc

SEQ ID NO: 322 - DNA, 18 bp, Artificial
  source: /note="Oligonucleotide base motif"
gatagggaaaagcacctg

SEQ ID NO: 323 - DNA, 18 bp, Artificial
  source: /note="Oligonucleotide base motif"
gtggatagggaaaagcac

SEQ ID NO: 324 - DNA, 18 bp, Artificial
  source: /note="Oligonucleotide base motif"
cctgtggatagggaaaag

SEQ ID NO: 325 - DNA, 18 bp, Artificial
  source: /note="Oligonucleotide base motif"
acccctgtggatagggaa

SEQ ID NO: 326 - DNA, 18 bp, Artificial
  source: /note="Oligonucleotide base motif"
aacacccctgtggatagg

SEQ ID NO: 327 - DNA, 18 bp, Artificial
  source: /note="Oligonucleotide base motif"
acaaacacccctgtggat

SEQ ID NO: 328 - DNA, 18 bp, Artificial
  source: /note="Oligonucleotide base motif"
cacacaaacacccctgtg

SEQ ID NO: 329 - DNA, 18 bp, Artificial
  source: /note="Oligonucleotide base motif"
acacacacaaacacccct

SEQ ID NO: 330 - DNA, 18 bp, Artificial
  source: /note="Oligonucleotide base motif"
cgcacacacacaaacacc

SEQ ID NO: 331 - DNA, 18 bp, Artificial
  source: /note="Oligonucleotide base motif"
acgcgcacacacacaaac

SEQ ID NO: 332 - DNA, 18 bp, Artificial
  source: /note="Oligonucleotide base motif"
cacacgcgcacacacaca

SEQ ID NO: 333 - DNA, 18 bp, Artificial
  source: /note="Oligonucleotide base motif"
acgcacacgcgcacacac

SEQ ID NO: 334 - DNA, 18 bp, Artificial
  source: /note="Oligonucleotide base motif"
gaaacgcacacgcgcaca

SEQ ID NO: 335 - DNA, 18 bp, Artificial
  source: /note="Oligonucleotide base motif"
attgaaacgcacacgcgc

SEQ ID NO: 336 - DNA, 18 bp, Artificial
  source: /note="Oligonucleotide base motif"
tttattgaaacgcacacg

SEQ ID NO: 337 - DNA, 18 bp, Artificial
  source: /note="Oligonucleotide base motif"
aactttattgaaacgcac

SEQ ID NO: 338 - DNA, 18 bp, Artificial
  source: /note="Oligonucleotide base motif"
acaaactttattgaaacg

SEQ ID NO: 339 - DNA, 18 bp, Artificial
  source: /note="Oligonucleotide base motif"
tgtacaaactttattgaa

SEQ ID NO: 340 - DNA, 18 bp, Artificial
  source: /note="Oligonucleotide base motif"
aagtgtacaaactttatt

SEQ ID NO: 341 - DNA, 18 bp, Artificial
  source: /note="Oligonucleotide base motif"
agaaagtgtacaaacttt

SEQ ID NO: 342 - DNA, 18 bp, Artificial
  source: /note="Oligonucleotide base motif"
ttaagaaagtgtacaaac

SEQ ID NO: 343 - DNA, 16 bp, Homo sapiens
ggcgagaggaagcagg

SEQ ID NO: 344 - DNA, 16 bp, Homo sapiens
gcgagaggaagcaggg

SEQ ID NO: 345 - DNA, 16 bp, Homo sapiens
cgagaggaagcaggga

SEQ ID NO: 346 - DNA, 16 bp, Homo sapiens
gagaggaagcagggag

SEQ ID NO: 347 - DNA, 16 bp, Homo sapiens
agaggaagcagggagg

SEQ ID NO: 348 - DNA, 16 bp, Homo sapiens
gaggaagcagggagga

SEQ ID NO: 349 - DNA, 16 bp, Homo sapiens
aggaagcagggaggag

SEQ ID NO: 350 - DNA, 16 bp, Homo sapiens
ggaagcagggaggaga

SEQ ID NO: 351 - DNA, 16 bp, Homo sapiens
gaagcagggaggagag

SEQ ID NO: 352 - DNA, 16 bp, Homo sapiens
aagcagggaggagagt

SEQ ID NO: 353 - DNA, 16 bp, Homo sapiens
agcagggaggagagtg

SEQ ID NO: 354 - DNA, 16 bp, Homo sapiens
gcagggaggagagtga

SEQ ID NO: 355 - DNA, 16 bp, Homo sapiens
cagggaggagagtgat

SEQ ID NO: 356 - DNA, 16 bp, Homo sapiens
agggaggagagtgatt

SEQ ID NO: 357 - DNA, 16 bp, Homo sapiens
gggaggagagtgattt

SEQ ID NO: 358 - DNA, 16 bp, Homo sapiens
ggaggagagtgatttg

SEQ ID NO: 359 - DNA, 16 bp, Homo sapiens
gaggagagtgatttga

SEQ ID NO: 360 - DNA, 16 bp, Homo sapiens
aggagagtgatttgag

SEQ ID NO: 361 - DNA, 16 bp, Homo sapiens
ggagagtgatttgagt

SEQ ID NO: 362 - DNA, 16 bp, Homo sapiens
gagagtgatttgagta

SEQ ID NO: 363 - DNA, 16 bp, Homo sapiens
agagtgatttgagtag

SEQ ID NO: 364 - DNA, 16 bp, Homo sapiens
gagtgatttgagtaga

SEQ ID NO: 365 - DNA, 16 bp, Homo sapiens
agtgatttgagtagaa

SEQ ID NO: 366 - DNA, 16 bp, Homo sapiens
gtgatttgagtagaaa

SEQ ID NO: 367 - DNA, 16 bp, Homo sapiens
tgatttgagtagaaaa

SEQ ID NO: 368 - DNA, 16 bp, Homo sapiens
gatttgagtagaaaag

SEQ ID NO: 369 - DNA, 16 bp, Homo sapiens
atttgagtagaaaaga

SEQ ID NO: 370 - DNA, 16 bp, Homo sapiens
tttgagtagaaaagaa

SEQ ID NO: 371 - DNA, 16 bp, Homo sapiens
ttgagtagaaaagaaa

SEQ ID NO: 372 - DNA, 16 bp, Homo sapiens
tgagtagaaaagaaac

SEQ ID NO: 373 - DNA, 16 bp, Homo sapiens
gagtagaaaagaaaca

SEQ ID NO: 374 - DNA, 16 bp, Homo sapiens
agtagaaaagaaacac

SEQ ID NO: 375 - DNA, 16 bp, Homo sapiens
gtagaaaagaaacaca

SEQ ID NO: 376 - DNA, 16 bp, Homo sapiens
tagaaaagaaacacag

SEQ ID NO: 377 - DNA, 16 bp, Homo sapiens
agaaaagaaacacagc

SEQ ID NO: 378 - DNA, 16 bp, Homo sapiens
gaaaagaaacacagca

SEQ ID NO: 379 - DNA, 16 bp, Homo sapiens
aaaagaaacacagcat

SEQ ID NO: 380 - DNA, 16 bp, Homo sapiens
aaagaaacacagcatt

SEQ ID NO: 381 - DNA, 16 bp, Homo sapiens
aagaaacacagcattc

SEQ ID NO: 382 - DNA, 16 bp, Homo sapiens
agaaacacagcattcc

SEQ ID NO: 383 - DNA, 16 bp, Homo sapiens
gaaacacagcattcca

SEQ ID NO: 384 - DNA, 16 bp, Homo sapiens
aaacacagcattccag

SEQ ID NO: 385 - DNA, 16 bp, Homo sapiens
aacacagcattccagg

SEQ ID NO: 386 - DNA, 16 bp, Homo sapiens
acacagcattccaggc

SEQ ID NO: 387 - DNA, 16 bp, Homo sapiens
cacagcattccaggct

SEQ ID NO: 388 - DNA, 16 bp, Homo sapiens
acagcattccaggctg

SEQ ID NO: 389 - DNA, 16 bp, Homo sapiens
cagcattccaggctgg

SEQ ID NO: 390 - DNA, 16 bp, Homo sapiens
agcattccaggctggc

SEQ ID NO: 391 - DNA, 16 bp, Homo sapiens
gcattccaggctggcc

SEQ ID NO: 392 - DNA, 16 bp, Homo sapiens
cattccaggctggccc

SEQ ID NO: 393 - DNA, 16 bp, Homo sapiens
attccaggctggcccc

SEQ ID NO: 394 - DNA, 16 bp, Homo sapiens
ttccaggctggcccca

SEQ ID NO: 395 - DNA, 16 bp, Homo sapiens
tccaggctggccccac

SEQ ID NO: 396 - DNA, 16 bp, Homo sapiens
ccaggctggccccacc

SEQ ID NO: 397 - DNA, 16 bp, Homo sapiens
caggctggccccacct

SEQ ID NO: 398 - DNA, 16 bp, Homo sapiens
aggctggccccacctc

SEQ ID NO: 399 - DNA, 16 bp, Homo sapiens
ggctggccccacctct

SEQ ID NO: 400 - DNA, 16 bp, Homo sapiens
gctggccccacctcta

SEQ ID NO: 401 - DNA, 16 bp, Homo sapiens
ctggccccacctctat

SEQ ID NO: 402 - DNA, 16 bp, Homo sapiens
tggccccacctctata

SEQ ID NO: 403 - DNA, 16 bp, Homo sapiens
ggccccacctctatat

SEQ ID NO: 404 - DNA, 16 bp, Homo sapiens
gccccacctctatatt

SEQ ID NO: 405 - DNA, 16 bp, Homo sapiens
ccccacctctatattg

SEQ ID NO: 406 - DNA, 16 bp, Homo sapiens
cccacctctatattga

SEQ ID NO: 407 - DNA, 16 bp, Homo sapiens
ccacctctatattgat

SEQ ID NO: 408 - DNA, 16 bp, Homo sapiens
cacctctatattgata

SEQ ID NO: 409 - DNA, 16 bp, Homo sapiens
acctctatattgataa

SEQ ID NO: 410 - DNA, 16 bp, Homo sapiens
cctctatattgataag

SEQ ID NO: 411 - DNA, 16 bp, Homo sapiens
ctctatattgataagt

SEQ ID NO: 412 - DNA, 16 bp, Homo sapiens
tctatattgataagta

SEQ ID NO: 413 - DNA, 16 bp, Homo sapiens
ctatattgataagtag

SEQ ID NO: 414 - DNA, 16 bp, Homo sapiens
tatattgataagtagc

SEQ ID NO: 415 - DNA, 16 bp, Homo sapiens
atattgataagtagcc

SEQ ID NO: 416 - DNA, 16 bp, Homo sapiens
tattgataagtagcca

SEQ ID NO: 417 - DNA, 16 bp, Homo sapiens
attgataagtagccaa

SEQ ID NO: 418 - DNA, 16 bp, Homo sapiens
ttgataagtagccaat

SEQ ID NO: 419 - DNA, 16 bp, Homo sapiens
tgataagtagccaatg

SEQ ID NO: 420 - DNA, 16 bp, Homo sapiens
gataagtagccaatgg

SEQ ID NO: 421 - DNA, 16 bp, Homo sapiens
ataagtagccaatggg

SEQ ID NO: 422 - DNA, 16 bp, Homo sapiens
taagtagccaatggga

SEQ ID NO: 423 - DNA, 16 bp, Homo sapiens
aagtagccaatgggag

SEQ ID NO: 424 - DNA, 16 bp, Homo sapiens
agtagccaatgggagc

SEQ ID NO: 425 - DNA, 16 bp, Homo sapiens
gtagccaatgggagcg

SEQ ID NO: 426 - DNA, 16 bp, Homo sapiens
tagccaatgggagcgg

SEQ ID NO: 427 - DNA, 16 bp, Homo sapiens
agccaatgggagcggg

SEQ ID NO: 428 - DNA, 16 bp, Homo sapiens
gccaatgggagcgggt

SEQ ID NO: 429 - DNA, 16 bp, Homo sapiens
ccaatgggagcgggta

SEQ ID NO: 430 - DNA, 16 bp, Homo sapiens
caatgggagcgggtag

SEQ ID NO: 431 - DNA, 16 bp, Homo sapiens
aatgggagcgggtagc

SEQ ID NO: 432 - DNA, 16 bp, Homo sapiens
atgggagcgggtagcc

SEQ ID NO: 433 - DNA, 16 bp, Homo sapiens
tgggagcgggtagccc

SEQ ID NO: 434 - DNA, 16 bp, Homo sapiens
gggagcgggtagccct

SEQ ID NO: 435 - DNA, 16 bp, Homo sapiens
ggagcgggtagccctg

SEQ ID NO: 436 - DNA, 16 bp, Homo sapiens
gagcgggtagccctga

SEQ ID NO: 437 - DNA, 16 bp, Homo sapiens
agcgggtagccctgat

SEQ ID NO: 438 - DNA, 16 bp, Homo sapiens
gcgggtagccctgatc

SEQ ID NO: 439 - DNA, 16 bp, Homo sapiens
cgggtagccctgatcc

SEQ ID NO: 440 - DNA, 16 bp, Homo sapiens
gggtagccctgatccc

SEQ ID NO: 441 - DNA, 16 bp, Homo sapiens
ggtagccctgatccct

SEQ ID NO: 442 - DNA, 16 bp, Homo sapiens
gtagccctgatccctg

SEQ ID NO: 443 - DNA, 16 bp, Homo sapiens
tagccctgatccctgg

SEQ ID NO: 444 - DNA, 16 bp, Homo sapiens
agccctgatccctggc

SEQ ID NO: 445 - DNA, 16 bp, Homo sapiens
gccctgatccctggcc

SEQ ID NO: 446 - DNA, 16 bp, Homo sapiens
ccctgatccctggcca

SEQ ID NO: 447 - DNA, 16 bp, Homo sapiens
cctgatccctggccaa

SEQ ID NO: 448 - DNA, 16 bp, Homo sapiens
ctgatccctggccaat

SEQ ID NO: 449 - DNA, 16 bp, Homo sapiens
tgatccctggccaatg

SEQ ID NO: 450 - DNA, 16 bp, Homo sapiens
gatccctggccaatgg

SEQ ID NO: 451 - DNA, 16 bp, Homo sapiens
atccctggccaatgga

SEQ ID NO: 452 - DNA, 16 bp, Homo sapiens
tccctggccaatggaa

SEQ ID NO: 453 - DNA, 16 bp, Homo sapiens
ccctggccaatggaaa

SEQ ID NO: 454 - DNA, 16 bp, Homo sapiens
cctggccaatggaaac

SEQ ID NO: 455 - DNA, 16 bp, Homo sapiens
ctggccaatggaaact

SEQ ID NO: 456 - DNA, 16 bp, Homo sapiens
tggccaatggaaactg

SEQ ID NO: 457 - DNA, 16 bp, Homo sapiens
ggccaatggaaactga

SEQ ID NO: 458 - DNA, 16 bp, Homo sapiens
gccaatggaaactgag

SEQ ID NO: 459 - DNA, 16 bp, Homo sapiens
ccaatggaaactgagg

SEQ ID NO: 460 - DNA, 16 bp, Homo sapiens
caatggaaactgaggt

SEQ ID NO: 461 - DNA, 16 bp, Homo sapiens
aatggaaactgaggta

SEQ ID NO: 462 - DNA, 16 bp, Homo sapiens
atggaaactgaggtag

SEQ ID NO: 463 - DNA, 16 bp, Homo sapiens
tggaaactgaggtagg

SEQ ID NO: 464 - DNA, 16 bp, Homo sapiens
ggaaactgaggtaggc

SEQ ID NO: 465 - DNA, 16 bp, Homo sapiens
gaaactgaggtaggcg

SEQ ID NO: 466 - DNA, 16 bp, Homo sapiens
aaactgaggtaggcgg

SEQ ID NO: 467 - DNA, 16 bp, Homo sapiens
aactgaggtaggcggg

SEQ ID NO: 468 - DNA, 16 bp, Homo sapiens
actgaggtaggcgggt

SEQ ID NO: 469 - DNA, 16 bp, Homo sapiens
ctgaggtaggcgggtc

SEQ ID NO: 470 - DNA, 16 bp, Homo sapiens
tgaggtaggcgggtca

SEQ ID NO: 471 - DNA, 16 bp, Homo sapiens
gaggtaggcgggtcat

SEQ ID NO: 472 - DNA, 16 bp, Homo sapiens
aggtaggcgggtcatc

SEQ ID NO: 473 - DNA, 16 bp, Homo sapiens
ggtaggcgggtcatcg

SEQ ID NO: 474 - DNA, 16 bp, Homo sapiens
gtaggcgggtcatcgc

SEQ ID NO: 475 - DNA, 16 bp, Homo sapiens
taggcgggtcatcgcg

SEQ ID NO: 476 - DNA, 16 bp, Homo sapiens
aggcgggtcatcgcgc

SEQ ID NO: 477 - DNA, 16 bp, Homo sapiens
ggcgggtcatcgcgct

SEQ ID NO: 478 - DNA, 16 bp, Homo sapiens
gcgggtcatcgcgctg

SEQ ID NO: 479 - DNA, 16 bp, Homo sapiens
cgggtcatcgcgctgg

SEQ ID NO: 480 - DNA, 16 bp, Homo sapiens
gggtcatcgcgctggg

SEQ ID NO: 481 - DNA, 16 bp, Homo sapiens
ggtcatcgcgctgggg

SEQ ID NO: 482 - DNA, 16 bp, Homo sapiens
gtcatcgcgctggggt

SEQ ID NO: 483 - DNA, 16 bp, Homo sapiens
tcatcgcgctggggtc

SEQ ID NO: 484 - DNA, 16 bp, Homo sapiens
catcgcgctggggtct

SEQ ID NO: 485 - DNA, 16 bp, Homo sapiens
atcgcgctggggtctg

SEQ ID NO: 486 - DNA, 16 bp, Homo sapiens
tcgcgctggggtctgt

SEQ ID NO: 487 - DNA, 16 bp, Homo sapiens
cgcgctggggtctgta

SEQ ID NO: 488 - DNA, 16 bp, Homo sapiens
gcgctggggtctgtag

SEQ ID NO: 489 - DNA, 16 bp, Homo sapiens
cgctggggtctgtagt

SEQ ID NO: 490 - DNA, 16 bp, Homo sapiens
gctggggtctgtagtc

SEQ ID NO: 491 - DNA, 16 bp, Homo sapiens
ctggggtctgtagtct

SEQ ID NO: 492 - DNA, 16 bp, Homo sapiens
tggggtctgtagtctg

SEQ ID NO: 493 - DNA, 16 bp, Homo sapiens
ggggtctgtagtctga

SEQ ID NO: 494 - DNA, 16 bp, Homo sapiens
gggtctgtagtctgag

SEQ ID NO: 495 - DNA, 16 bp, Homo sapiens
ggtctgtagtctgagc

SEQ ID NO: 496 - DNA, 16 bp, Homo sapiens
gtctgtagtctgagcg

SEQ ID NO: 497 - DNA, 16 bp, Homo sapiens
tctgtagtctgagcgc

SEQ ID NO: 498 - DNA, 16 bp, Homo sapiens
ctgtagtctgagcgct

SEQ ID NO: 499 - DNA, 16 bp, Homo sapiens
tgtagtctgagcgcta

SEQ ID NO: 500 - DNA, 16 bp, Homo sapiens
gtagtctgagcgctac

SEQ ID NO: 501 - DNA, 16 bp, Homo sapiens
tagtctgagcgctacc

SEQ ID NO: 502 - DNA, 16 bp, Homo sapiens
agtctgagcgctaccc

SEQ ID NO: 503 - DNA, 16 bp, Homo sapiens
gtctgagcgctacccg

SEQ ID NO: 504 - DNA, 16 bp, Homo sapiens
tctgagcgctacccgg

SEQ ID NO: 505 - DNA, 16 bp, Homo sapiens
ctgagcgctacccggt

SEQ ID NO: 506 - DNA, 16 bp, Homo sapiens
tgagcgctacccggtt

SEQ ID NO: 507 - DNA, 16 bp, Homo sapiens
gagcgctacccggttg

SEQ ID NO: 508 - DNA, 16 bp, Homo sapiens
agcgctacccggttgc

SEQ ID NO: 509 - DNA, 16 bp, Homo sapiens
gcgctacccggttgct

SEQ ID NO: 510 - DNA, 16 bp, Homo sapiens
cgctacccggttgctg

SEQ ID NO: 511 - DNA, 16 bp, Homo sapiens
gctacccggttgctgc

SEQ ID NO: 512 - DNA, 16 bp, Homo sapiens
ctacccggttgctgct

SEQ ID NO: 513 - DNA, 16 bp, Homo sapiens
tacccggttgctgctg

SEQ ID NO: 514 - DNA, 16 bp, Homo sapiens
acccggttgctgctgc

SEQ ID NO: 515 - DNA, 16 bp, Homo sapiens
cccggttgctgctgcc

SEQ ID NO: 516 - DNA, 16 bp, Homo sapiens
ccggttgctgctgccc

SEQ ID NO: 517 - DNA, 16 bp, Homo sapiens
cggttgctgctgccca

SEQ ID NO: 518 - DNA, 16 bp, Homo sapiens
ggttgctgctgcccaa

SEQ ID NO: 519 - DNA, 16 bp, Homo sapiens
gttgctgctgcccaag

SEQ ID NO: 520 - DNA, 16 bp, Homo sapiens
ttgctgctgcccaagg

SEQ ID NO: 521 - DNA, 16 bp, Homo sapiens
tgctgctgcccaagga

SEQ ID NO: 522 - DNA, 16 bp, Homo sapiens
gctgctgcccaaggac

SEQ ID NO: 523 - DNA, 16 bp, Homo sapiens
ctgctgcccaaggacc

SEQ ID NO: 524 - DNA, 16 bp, Homo sapiens
tgctgcccaaggaccg

SEQ ID NO: 525 - DNA, 16 bp, Homo sapiens
gctgcccaaggaccgc

SEQ ID NO: 526 - DNA, 16 bp, Homo sapiens
ctgcccaaggaccgcg

SEQ ID NO: 527 - DNA, 16 bp, Homo sapiens
tgcccaaggaccgcgg

SEQ ID NO: 528 - DNA, 16 bp, Homo sapiens
gcccaaggaccgcgga

SEQ ID NO: 529 - DNA, 16 bp, Homo sapiens
cccaaggaccgcggag

SEQ ID NO: 530 - DNA, 16 bp, Homo sapiens
ccaaggaccgcggagt

SEQ ID NO: 531 - DNA, 16 bp, Homo sapiens
caaggaccgcggagtc

SEQ ID NO: 532 - DNA, 16 bp, Homo sapiens
aaggaccgcggagtcg

SEQ ID NO: 533 - DNA, 16 bp, Homo sapiens
aggaccgcggagtcgg

SEQ ID NO: 534 - DNA, 16 bp, Homo sapiens
ggaccgcggagtcgga

SEQ ID NO: 535 - DNA, 16 bp, Homo sapiens
gaccgcggagtcggac

SEQ ID NO: 536 - DNA, 16 bp, Homo sapiens
accgcggagtcggacg

SEQ ID NO: 537 - DNA, 16 bp, Homo sapiens
ccgcggagtcggacgc

SEQ ID NO: 538 - DNA, 16 bp, Homo sapiens
cgcggagtcggacgca

SEQ ID NO: 539 - DNA, 16 bp, Homo sapiens
gcggagtcggacgcag

SEQ ID NO: 540 - DNA, 16 bp, Homo sapiens
cggagtcggacgcagg

SEQ ID NO: 541 - DNA, 16 bp, Homo sapiens
ggagtcggacgcaggc

SEQ ID NO: 542 - DNA, 16 bp, Homo sapiens
gagtcggacgcaggca

SEQ ID NO: 543 - DNA, 16 bp, Homo sapiens
agtcggacgcaggcag

SEQ ID NO: 544 - DNA, 16 bp, Homo sapiens
gtcggacgcaggcaga

SEQ ID NO: 545 - DNA, 16 bp, Homo sapiens
tcggacgcaggcagac

SEQ ID NO: 546 - DNA, 16 bp, Homo sapiens
cggacgcaggcagacc

SEQ ID NO: 547 - DNA, 18 bp, Homo sapiens
taagtagccaatgggagc

SEQ ID NO: 548 - DNA, 18 bp, Homo sapiens
aagtagccaatgggagcg

SEQ ID NO: 549 - DNA, 18 bp, Homo sapiens
agtagccaatgggagcgg

SEQ ID NO: 550 - DNA, 18 bp, Homo sapiens
gtagccaatgggagcggg

SEQ ID NO: 551 - DNA, 18 bp, Homo sapiens
tagccaatgggagcgggt

SEQ ID NO: 552 - DNA, 18 bp, Homo sapiens
agccaatgggagcgggta

SEQ ID NO: 553 - DNA, 18 bp, Homo sapiens
gccaatgggagcgggtag

SEQ ID NO: 554 - DNA, 18 bp, Homo sapiens
ccaatgggagcgggtagc

SEQ ID NO: 555 - DNA, 18 bp, Homo sapiens
caatgggagcgggtagcc

SEQ ID NO: 556 - DNA, 18 bp, Homo sapiens
aatgggagcgggtagccc

SEQ ID NO: 557 - DNA, 18 bp, Homo sapiens
atgggagcgggtagccct

SEQ ID NO: 558 - DNA, 18 bp, Homo sapiens
tgggagcgggtagccctg

SEQ ID NO: 559 - DNA, 18 bp, Homo sapiens
gggagcgggtagccctga

SEQ ID NO: 560 - DNA, 18 bp, Homo sapiens
ggagcgggtagccctgat

SEQ ID NO: 561 - DNA, 18 bp, Homo sapiens
gagcgggtagccctgatc

SEQ ID NO: 562 - DNA, 18 bp, Homo sapiens
agcgggtagccctgatcc

SEQ ID NO: 563 - DNA, 18 bp, Homo sapiens
gcgggtagccctgatccc

SEQ ID NO: 564 - DNA, 18 bp, Homo sapiens
cgggtagccctgatccct

SEQ ID NO: 565 - DNA, 18 bp, Homo sapiens
gggtagccctgatccctg

SEQ ID NO: 566 - DNA, 18 bp, Homo sapiens
ggtagccctgatccctgg

SEQ ID NO: 567 - DNA, 18 bp, Homo sapiens
gtagccctgatccctggc

SEQ ID NO: 568 - DNA, 18 bp, Homo sapiens
tagccctgatccctggcc

SEQ ID NO: 569 - DNA, 18 bp, Homo sapiens
agccctgatccctggcca

SEQ ID NO: 570 - DNA, 18 bp, Homo sapiens
gccctgatccctggccaa

SEQ ID NO: 571 - DNA, 18 bp, Homo sapiens
ccctgatccctggccaat

SEQ ID NO: 572 - DNA, 18 bp, Homo sapiens
cctgatccctggccaatg

SEQ ID NO: 573 - DNA, 18 bp, Homo sapiens
ctgatccctggccaatgg

SEQ ID NO: 574 - DNA, 18 bp, Homo sapiens
tgatccctggccaatgga

SEQ ID NO: 575 - DNA, 18 bp, Homo sapiens
gatccctggccaatggaa

SEQ ID NO: 576 - DNA, 18 bp, Homo sapiens
atccctggccaatggaaa

SEQ ID NO: 577 - DNA, 18 bp, Homo sapiens
tccctggccaatggaaac

SEQ ID NO: 578 - DNA, 18 bp, Homo sapiens
ccctggccaatggaaact

SEQ ID NO: 579 - DNA, 18 bp, Homo sapiens
cctggccaatggaaactg

SEQ ID NO: 580 - DNA, 18 bp, Homo sapiens
ctggccaatggaaactga

SEQ ID NO: 581 - DNA, 18 bp, Homo sapiens
tggccaatggaaactgag

SEQ ID NO: 582 - DNA, 18 bp, Homo sapiens
ggccaatggaaactgagg

SEQ ID NO: 583 - DNA, 18 bp, Homo sapiens
gccaatggaaactgaggt

SEQ ID NO: 584 - DNA, 18 bp, Homo sapiens
ccaatggaaactgaggta

SEQ ID NO: 585 - DNA, 18 bp, Homo sapiens
caatggaaactgaggtag

SEQ ID NO: 586 - DNA, 18 bp, Homo sapiens
aatggaaactgaggtagg

SEQ ID NO: 587 - DNA, 18 bp, Homo sapiens
agtactgaagactctgca

SEQ ID NO: 588 - DNA, 18 bp, Homo sapiens
actgaagactctgcagcc

SEQ ID NO: 589 - DNA, 18 bp, Homo sapiens
gaagactctgcagccctc

SEQ ID NO: 590 - DNA, 18 bp, Homo sapiens
gactctgcagccctcggg

SEQ ID NO: 591 - DNA, 18 bp, Homo sapiens
tctgcagccctcgggacc

SEQ ID NO: 592 - DNA, 18 bp, Homo sapiens
gcagccctcgggacccca

SEQ ID NO: 593 - DNA, 18 bp, Homo sapiens
gccctcgggaccccactc

SEQ ID NO: 594 - DNA, 18 bp, Homo sapiens
ctcgggaccccactcgga

SEQ ID NO: 595 - DNA, 18 bp, Homo sapiens
gggaccccactcggaggg

SEQ ID NO: 596 - DNA, 18 bp, Homo sapiens
accccactcggagggtgc

SEQ ID NO: 597 - DNA, 18 bp, Homo sapiens
ccactcggagggtgccct

SEQ ID NO: 598 - DNA, 18 bp, Homo sapiens
ctcggagggtgccctctg

SEQ ID NO: 599 - DNA, 18 bp, Homo sapiens
ggagggtgccctctgctc

SEQ ID NO: 600 - DNA, 18 bp, Homo sapiens
gggtgccctctgctcagg

SEQ ID NO: 601 - DNA, 18 bp, Homo sapiens
tgccctctgctcaggcct

SEQ ID NO: 602 - DNA, 18 bp, Homo sapiens
cctctgctcaggcctccc

SEQ ID NO: 603 - DNA, 18 bp, Homo sapiens
ctgctcaggcctccctag

SEQ ID NO: 604 - DNA, 18 bp, Homo sapiens
ctcaggcctccctagcac

SEQ ID NO: 605 - DNA, 18 bp, Homo sapiens
aggcctccctagcacctc

SEQ ID NO: 606 - DNA, 18 bp, Homo sapiens
cctccctagcacctcccc

SEQ ID NO: 607 - DNA, 18 bp, Homo sapiens
ccctagcacctcccccta

SEQ ID NO: 608 - DNA, 18 bp, Homo sapiens
tagcacctccccctaacc

SEQ ID NO: 609 - DNA, 18 bp, Homo sapiens
cacctccccctaaccaaa

SEQ ID NO: 610 - DNA, 18 bp, Homo sapiens
ctccccctaaccaaattc

SEQ ID NO: 611 - DNA, 18 bp, Homo sapiens
cccctaaccaaattctcc

SEQ ID NO: 612 - DNA, 18 bp, Homo sapiens
ctaaccaaattctccctg

SEQ ID NO: 613 - DNA, 18 bp, Homo sapiens
accaaattctccctggac

SEQ ID NO: 614 - DNA, 18 bp, Homo sapiens
aaattctccctggacccc

SEQ ID NO: 615 - DNA, 18 bp, Homo sapiens
ttctccctggaccccatt

SEQ ID NO: 616 - DNA, 18 bp, Homo sapiens
tccctggaccccattctg

SEQ ID NO: 617 - DNA, 18 bp, Homo sapiens
ctggaccccattctgagc

SEQ ID NO: 618 - DNA, 18 bp, Homo sapiens
gaccccattctgagctcc

SEQ ID NO: 619 - DNA, 18 bp, Homo sapiens
cccattctgagctcccca

SEQ ID NO: 620 - DNA, 18 bp, Homo sapiens
attctgagctccccatca

SEQ ID NO: 621 - DNA, 18 bp, Homo sapiens
ctgagctccccatcacca

SEQ ID NO: 622 - DNA, 18 bp, Homo sapiens
agctccccatcaccatgg

SEQ ID NO: 623 - DNA, 18 bp, Homo sapiens
tccccatcaccatgggag

SEQ ID NO: 624 - DNA, 18 bp, Homo sapiens
ccatcaccatgggaggtg

SEQ ID NO: 625 - DNA, 18 bp, Homo sapiens
tcaccatgggaggtgggg

SEQ ID NO: 626 - DNA, 18 bp, Homo sapiens
ccatgggaggtggggcct

SEQ ID NO: 627 - DNA, 18 bp, Homo sapiens
tgggaggtggggcctcaa

SEQ ID NO: 628 - DNA, 18 bp, Homo sapiens
gaggtggggcctcaatct

SEQ ID NO: 629 - DNA, 18 bp, Homo sapiens
gtggggcctcaatctaag

SEQ ID NO: 630 - DNA, 18 bp, Homo sapiens
gggcctcaatctaaggcc

SEQ ID NO: 631 - DNA, 18 bp, Homo sapiens
cctcaatctaaggccttc

SEQ ID NO: 632 - DNA, 18 bp, Homo sapiens
caatctaaggccttccct

SEQ ID NO: 633 - DNA, 18 bp, Homo sapiens
tctaaggccttccctgtc

SEQ ID NO: 634 - DNA, 18 bp, Homo sapiens
aaggccttccctgtcaga

SEQ ID NO: 635 - DNA, 18 bp, Homo sapiens
gccttccctgtcagaagg

SEQ ID NO: 636 - DNA, 18 bp, Homo sapiens
ttccctgtcagaaggggg

SEQ ID NO: 637 - DNA, 18 bp, Homo sapiens
cctgtcagaagggggttg

SEQ ID NO: 638 - DNA, 18 bp, Homo sapiens
gtcagaagggggttgtgg

SEQ ID NO: 639 - DNA, 18 bp, Homo sapiens
agaagggggttgtggcaa

SEQ ID NO: 640 - DNA, 18 bp, Homo sapiens
agggggttgtggcaaaag

SEQ ID NO: 641 - DNA, 18 bp, Homo sapiens
gggttgtggcaaaagcca

SEQ ID NO: 642 - DNA, 18 bp, Homo sapiens
ttgtggcaaaagccacat

SEQ ID NO: 643 - DNA, 18 bp, Homo sapiens
tggcaaaagccacattac

SEQ ID NO: 644 - DNA, 18 bp, Homo sapiens
caaaagccacattacaag

SEQ ID NO: 645 - DNA, 18 bp, Homo sapiens
aagccacattacaagctg

SEQ ID NO: 646 - DNA, 18 bp, Homo sapiens
ccacattacaagctgcca

SEQ ID NO: 647 - DNA, 18 bp, Homo sapiens
cattacaagctgccatcc

SEQ ID NO: 648 - DNA, 18 bp, Homo sapiens
tacaagctgccatcccct

SEQ ID NO: 649 - DNA, 18 bp, Homo sapiens
aagctgccatcccctccc

SEQ ID NO: 650 - DNA, 18 bp, Homo sapiens
ctgccatcccctccccgt

SEQ ID NO: 651 - DNA, 18 bp, Homo sapiens
ccatcccctccccgtttc

SEQ ID NO: 652 - DNA, 18 bp, Homo sapiens
tcccctccccgtttcagt

SEQ ID NO: 653 - DNA, 18 bp, Homo sapiens
cctccccgtttcagtgga

SEQ ID NO: 654 - DNA, 18 bp, Homo sapiens
ccccgtttcagtggaccc

SEQ ID NO: 655 - DNA, 18 bp, Homo sapiens
cgtttcagtggaccctgt

SEQ ID NO: 656 - DNA, 18 bp, Homo sapiens
ttcagtggaccctgtggc

SEQ ID NO: 657 - DNA, 18 bp, Homo sapiens
agtggaccctgtggccag

SEQ ID NO: 658 - DNA, 18 bp, Homo sapiens
ggaccctgtggccaggtg

SEQ ID NO: 659 - DNA, 18 bp, Homo sapiens
ccctgtggccaggtgctt

SEQ ID NO: 660 - DNA, 18 bp, Homo sapiens
tgtggccaggtgcttttc

SEQ ID NO: 661 - DNA, 18 bp, Homo sapiens
ggccaggtgcttttccct

SEQ ID NO: 662 - DNA, 18 bp, Homo sapiens
caggtgcttttccctatc

SEQ ID NO: 663 - DNA, 18 bp, Homo sapiens
gtgcttttccctatccac

SEQ ID NO: 664 - DNA, 18 bp, Homo sapiens
cttttccctatccacagg

SEQ ID NO: 665 - DNA, 18 bp, Homo sapiens
ttccctatccacaggggt

SEQ ID NO: 666 - DNA, 18 bp, Homo sapiens
cctatccacaggggtgtt

SEQ ID NO: 667 - DNA, 18 bp, Homo sapiens
atccacaggggtgtttgt

SEQ ID NO: 668 - DNA, 18 bp, Homo sapiens
cacaggggtgtttgtgtg

SEQ ID NO: 669 - DNA, 18 bp, Homo sapiens
aggggtgtttgtgtgtgt

SEQ ID NO: 670 - DNA, 18 bp, Homo sapiens
ggtgtttgtgtgtgtgcg

SEQ ID NO: 671 - DNA, 18 bp, Homo sapiens
gtttgtgtgtgtgcgcgt

SEQ ID NO: 672 - DNA, 18 bp, Homo sapiens
tgtgtgtgtgcgcgtgtg

SEQ ID NO: 673 - DNA, 18 bp, Homo sapiens
gtgtgtgcgcgtgtgcgt

SEQ ID NO: 674 - DNA, 18 bp, Homo sapiens
tgtgcgcgtgtgcgtttc

SEQ ID NO: 675 - DNA, 18 bp, Homo sapiens
gcgcgtgtgcgtttcaat

SEQ ID NO: 676 - DNA, 18 bp, Homo sapiens
cgtgtgcgtttcaataaa

SEQ ID NO: 677 - DNA, 18 bp, Homo sapiens
gtgcgtttcaataaagtt

SEQ ID NO: 678 - DNA, 18 bp, Homo sapiens
cgtttcaataaagtttgt

SEQ ID NO: 679 - DNA, 18 bp, Homo sapiens
ttcaataaagtttgtaca

SEQ ID NO: 680 - DNA, 18 bp, Homo sapiens
aataaagtttgtacactt

SEQ ID NO: 681 - DNA, 18 bp, Homo sapiens
aaagtttgtacactttct

SEQ ID NO: 682 - DNA, 18 bp, Homo sapiens
gtttgtacactttcttaa

SEQ ID NO: 683 - DNA, 23 bp, Homo sapiens
tggccaatggaaactgaggtagg

SEQ ID NO: 684 - DNA, 33 bp, Homo sapiens
ccctagcacctccccctaaccaaattctccctg

SEQ ID NO: 685 - DNA, 21 bp, Homo sapiens
cccattctgagctccccatca

SEQ ID NO: 686 - DNA, 21 bp, Homo sapiens
agggggttgtggcaaaagcca

SEQ ID NO: 687 - DNA, 21 bp, Homo sapiens
ccatcccctccccgtttcagt

SEQ ID NO: 688 - DNA, 18 bp, Homo sapiens
atccacaggggtgtttgt

SEQ ID NO: 689 - DNA, 57 bp, Homo sapiens
taagtagccaatgggagcgggtagccctgatccctggccaatggaaactgaggtagg

SEQ ID NO: 690 - DNA, 219 bp, Artificial
  source: /note="primer sequence"
ggcgagaggaagcagggaggagagtgatttgagtagaaaagaaacacagcattccaggctggccccacctctatattgataagtagccaatgggagcgggtagccctgatccctggccaatggaaactgaggtaggcgggtcatcgcgctggggtctgtagtctgagcgctacccggttgctgctgcccaaggaccgcggagtcggacgcaggcagacc

SEQ ID NO: 691 - DNA, 128 bp, Artificial
  source: /note="primer sequence"
atggaaactgaggtaggcgggtcatcgcgctggggtctgtagtctgagcgctacccggttgctgctgcccaaggaccgcggagtcggacgcaggcagaccatggcttccaaggtgtacgaccccgagc

SEQ ID NO: 692 - DNA, 149 bp, Artificial
  source: /note="primer sequence"
tggccagggatcagggctacccgctcccattggctacttatcaatatagaggtggggccagcctggaatgctgtgtttcttttctactcaaatcactctcctccctgcttcctctcgccggctagcctatagtgagtcgtattaagtac

SEQ ID NO: 693 - DNA, 18 bp, Artificial Sequence
  source: /note="Description of Artificial Sequence: Synthetic oligonucleotide"
tttctagggatcatgtga

SEQ ID NO: 694 - DNA, 18 bp, Artificial Sequence
  source: /note="Description of Artificial Sequence: Synthetic oligonucleotide"
catttctagggatcatgt

SEQ ID NO: 695 - DNA, 18 bp, Artificial Sequence
  source: /note="Description of Artificial Sequence: Synthetic oligonucleotide"
cccatttctagggatcat

SEQ ID NO: 696 - DNA, 18 bp, Artificial Sequence
  source: /note="Description of Artificial Sequence: Synthetic oligonucleotide"
accccatttctagggatc

SEQ ID NO: 697 - DNA, 18 bp, Artificial Sequence
  source: /note="Description of Artificial Sequence: Synthetic oligonucleotide"
acaccccatttctaggga

SEQ ID NO: 698 - DNA, 18 bp, Artificial Sequence
  source: /note="Description of Artificial Sequence: Synthetic oligonucleotide"
ccacaccccatttctagg

SEQ ID NO: 699 - DNA, 18 bp, Artificial Sequence
  source: /note="Description of Artificial Sequence: Synthetic oligonucleotide"
ccccacaccccatttcta

SEQ ID NO: 700 - DNA, 18 bp, Artificial Sequence
  source: /note="Description of Artificial Sequence: Synthetic oligonucleotide"
cgccccacaccccatttc

SEQ ID NO: 701 - DNA, 18 bp, Artificial Sequence
  source: /note="Description of Artificial Sequence: Synthetic oligonucleotide"
ctcgccccacaccccatt

SEQ ID NO: 702 - DNA, 18 bp, Artificial Sequence
  source: /note="Description of Artificial Sequence: Synthetic oligonucleotide"
ctctcgccccacacccca

SEQ ID NO: 703 - DNA, 18 bp, Artificial Sequence
  source: /note="Description of Artificial Sequence: Synthetic oligonucleotide"
tcctctcgccccacaccc

SEQ ID NO: 704 - DNA, 18 bp, Artificial Sequence
  source: /note="Description of Artificial Sequence: Synthetic oligonucleotide"
cttcctctcgccccacac

SEQ ID NO: 705 - DNA, 18 bp, Artificial Sequence
  source: /note="Description of Artificial Sequence: Synthetic oligonucleotide"
tgcttcctctcgccccac

SEQ ID NO: 706 - DNA, 18 bp, Artificial Sequence
  source: /note="Description of Artificial Sequence: Synthetic oligonucleotide"
cctgcttcctctcgcccc

SEQ ID NO: 707 - DNA, 18 bp, Artificial Sequence
  source: /note="Description of Artificial Sequence: Synthetic oligonucleotide"
tggccagggatcagggct

SEQ ID NO: 708 - DNA, 18 bp, Artificial Sequence
  source: /note="Description of Artificial Sequence: Synthetic oligonucleotide"
ttggccagggatcagggc

SEQ ID NO: 709 - DNA, 18 bp, Artificial Sequence
  source: /note="Description of Artificial Sequence: Synthetic oligonucleotide"
attggccagggatcaggg

SEQ ID NO: 710 - DNA, 16 bp, Artificial Sequence
  source: /note="Description of Artificial Sequence: Synthetic oligonucleotide"
tggccagggatcaggg

SEQ ID NO: 711 - DNA, 18 bp, Artificial Sequence
  source: /note="Description of Artificial Sequence: Synthetic oligonucleotide"
ctgcgtccgactccgcgg

SEQ ID NO: 712 - DNA, 18 bp, Artificial Sequence
  source: /note="Description of Artificial Sequence: Synthetic oligonucleotide"
acctgcgtccgactccgc

SEQ ID NO: 713 - DNA, 18 bp, Artificial Sequence
  source: /note="Description of Artificial Sequence: Synthetic oligonucleotide"
ctacctgcgtccgactcc

SEQ ID NO: 714 - DNA, 18 bp, Artificial Sequence
  source: /note="Description of Artificial Sequence: Synthetic oligonucleotide"
tcctacctgcgtccgact

SEQ ID NO: 715 - DNA, 18 bp, Artificial Sequence
  source: /note="Description of Artificial Sequence: Synthetic oligonucleotide"
tctcctacctgcgtccga

SEQ ID NO: 716 - DNA, 18 bp, Artificial Sequence
  source: /note="Description of Artificial Sequence: Synthetic oligonucleotide"
gctctcctacctgcgtcc

SEQ ID NO: 717 - DNA, 18 bp, Artificial Sequence
  source: /note="Description of Artificial Sequence: Synthetic oligonucleotide"
ccgctctcctacctgcgt

SEQ ID NO: 718 - DNA, 18 bp, Artificial Sequence
  source: /note="Description of Artificial Sequence: Synthetic oligonucleotide"
ggccgctctcctacctgc

SEQ ID NO: 719 - DNA, 18 bp, Artificial Sequence
  source: /note="Description of Artificial Sequence: Synthetic oligonucleotide"
gcggccgctctcctacct

SEQ ID NO: 720 - DNA, 18 bp, Artificial Sequence
  source: /note="Description of Artificial Sequence: Synthetic oligonucleotide"
gcgcggccgctctcctac

SEQ ID NO: 721 - DNA, 18 bp, Artificial Sequence
  source: /note="Description of Artificial Sequence: Synthetic oligonucleotide"
ctgcgcggccgctctcct

SEQ ID NO: 722 - DNA, 18 bp, Artificial Sequence
  source: /note="Description of Artificial Sequence: Synthetic oligonucleotide"
gtctgcgcggccgctctc

SEQ ID NO: 723 - DNA, 18 bp, Artificial Sequence
  source: /note="Description of Artificial Sequence: Synthetic oligonucleotide"
aggtctgcgcggccgctc

SEQ ID NO: 724 - DNA, 18 bp, Artificial Sequence
  source: /note="Description of Artificial Sequence: Synthetic oligonucleotide"
agaggtctgcgcggccgc

SEQ ID NO: 725 - DNA, 18 bp, Artificial Sequence
  source: /note="Description of Artificial Sequence: Synthetic oligonucleotide"
cgagaggtctgcgcggcc

SEQ ID NO: 726 - DNA, 18 bp, Artificial Sequence
  source: /note="Description of Artificial Sequence: Synthetic oligonucleotide"
ggcgagaggtctgcgcgg

SEQ ID NO: 727 - DNA, 18 bp, Artificial Sequence
  source: /note="Description of Artificial Sequence: Synthetic oligonucleotide"
caggcgagaggtctgcgc

SEQ ID NO: 728 - DNA, 18 bp, Artificial Sequence
  source: /note="Description of Artificial Sequence: Synthetic oligonucleotide"
agcaggcgagaggtctgc

SEQ ID NO: 729 - DNA, 18 bp, Artificial Sequence
  source: /note="Description of Artificial Sequence: Synthetic oligonucleotide"
ggagcaggcgagaggtct

SEQ ID NO: 730 - DNA, 18 bp, Artificial Sequence
  source: /note="Description of Artificial Sequence: Synthetic oligonucleotide"
caggagcaggcgagaggt

SEQ ID NO: 731 - DNA, 18 bp, Artificial Sequence
  source: /note="Description of Artificial Sequence: Synthetic oligonucleotide"
ggcaggagcaggcgagag

SEQ ID NO: 732 - DNA, 18 bp, Artificial Sequence
  source: /note="Description of Artificial Sequence: Synthetic oligonucleotide"
tgggcaggagcaggcgag

SEQ ID NO: 733 - DNA, 18 bp, Artificial Sequence
  source: /note="Description of Artificial Sequence: Synthetic oligonucleotide"
cctgggcaggagcaggcg

SEQ ID NO: 734 - DNA, 18 bp, Artificial Sequence
  source: /note="Description of Artificial Sequence: Synthetic oligonucleotide"
cccctgggcaggagcagg

SEQ ID NO: 735 - DNA, 18 bp, Artificial Sequence
  source: /note="Description of Artificial Sequence: Synthetic oligonucleotide"
ggcccctgggcaggagca

SEQ ID NO: 736 - DNA, 18 bp, Artificial Sequence
  source: /note="Description of Artificial Sequence: Synthetic oligonucleotide"
cgggcccctgggcaggag

SEQ ID NO: 737 - DNA, 18 bp, Artificial Sequence
  source: /note="Description of Artificial Sequence: Synthetic oligonucleotide"
ggcgggcccctgggcagg

SEQ ID NO: 738 - DNA, 18 bp, Artificial Sequence
  source: /note="Description of Artificial Sequence: Synthetic oligonucleotide"
ctggcgggcccctgggca

SEQ ID NO: 739 - DNA, 18 bp, Artificial Sequence
  source: /note="Description of Artificial Sequence: Synthetic oligonucleotide"
ccctggcgggcccctggg

SEQ ID NO: 740 - DNA, 18 bp, Artificial Sequence
  source: /note="Description of Artificial Sequence: Synthetic oligonucleotide"
ggccctggcgggcccctg

SEQ ID NO: 741 - DNA, 18 bp, Artificial Sequence
  source: /note="Description of Artificial Sequence: Synthetic oligonucleotide"
atggccctggcgggcccc

SEQ ID NO: 742 - DNA, 18 bp, Artificial Sequence
  source: /note="Description of Artificial Sequence: Synthetic oligonucleotide"
acatggccctggcgggcc

SEQ ID NO: 743 - DNA, 18 bp, Artificial Sequence
  source: /note="Description of Artificial Sequence: Synthetic oligonucleotide"
tcacatggccctggcggg

SEQ ID NO: 744 - DNA, 18 bp, Artificial Sequence
  source: /note="Description of Artificial Sequence: Synthetic oligonucleotide"
gctcacatggccctggcg

SEQ ID NO: 745 - DNA, 18 bp, Artificial Sequence
  source: /note="Description of Artificial Sequence: Synthetic oligonucleotide"
aagctcacatggccctgg

SEQ ID NO: 746 - DNA, 18 bp, Artificial Sequence
  source: /note="Description of Artificial Sequence: Synthetic oligonucleotide"
tcaagctcacatggccct

SEQ ID NO: 747 - DNA, 18 bp, Artificial Sequence
  source: /note="Description of Artificial Sequence: Synthetic oligonucleotide"
ctcaagctcacatggccc

SEQ ID NO: 748 - DNA, 18 bp, Artificial Sequence
  source: /note="Description of Artificial Sequence: Synthetic oligonucleotide"
cctcaagctcacatggcc

SEQ ID NO: 749 - DNA, 16 bp, Artificial Sequence
  source: /note="Description of Artificial Sequence: Synthetic oligonucleotide"
ctcaagctcacatggc

SEQ ID NO: 750 - DNA, 18 bp, Artificial Sequence
  source: /note="Description of Artificial Sequence: Synthetic oligonucleotide"
acctcaagctcacatggc

SEQ ID NO: 751 - DNA, 18 bp, Artificial Sequence
  source: /note="Description of Artificial Sequence: Synthetic oligonucleotide"
aacctcaagctcacatgg

SEQ ID NO: 752 - DNA, 18 bp, Artificial Sequence
  source: /note="Description of Artificial Sequence: Synthetic oligonucleotide"
ggaacctcaagctcacat

SEQ ID NO: 753 - DNA, 18 bp, Artificial Sequence
  source: /note="Description of Artificial Sequence: Synthetic oligonucleotide"
ggggaacctcaagctcac

SEQ ID NO: 754 - DNA, 18 bp, Artificial Sequence
  source: /note="Description of Artificial Sequence: Synthetic oligonucleotide"
caggggaacctcaagctc

SEQ ID NO: 755 - DNA, 18 bp, Artificial Sequence
  source: /note="Description of Artificial Sequence: Synthetic oligonucleotide"
tccaggggaacctcaagc

SEQ ID NO: 756 - DNA, 18 bp, Artificial Sequence
  source: /note="Description of Artificial Sequence: Synthetic oligonucleotide"
actccaggggaacctcaa

SEQ ID NO: 757 - DNA, 18 bp, Artificial Sequence
  source: /note="Description of Artificial Sequence: Synthetic oligonucleotide"
agactccaggggaacctc

SEQ ID NO: 758 - DNA, 18 bp, Artificial Sequence
  source: /note="Description of Artificial Sequence: Synthetic oligonucleotide"
tgagactccaggggaacc

SEQ ID NO: 759 - DNA, 18 bp, Artificial Sequence
  source: /note="Description of Artificial Sequence: Synthetic oligonucleotide"
gctgagactccaggggaa

SEQ ID NO: 760 - DNA, 18 bp, Artificial Sequence
  source: /note="Description of Artificial Sequence: Synthetic oligonucleotide"
cggctgagactccagggg

SEQ ID NO: 761 - DNA, 18 bp, Artificial Sequence
  source: /note="Description of Artificial Sequence: Synthetic oligonucleotide"
tccggctgagactccagg

SEQ ID NO: 762 - DNA, 18 bp, Artificial Sequence
  source: /note="Description of Artificial Sequence: Synthetic oligonucleotide"
tctccggctgagactcca

SEQ ID NO: 763 - DNA, 18 bp, Artificial Sequence
  source: /note="Description of Artificial Sequence: Synthetic oligonucleotide"
tgtctccggctgagactc

SEQ ID NO: 764 - DNA, 18 bp, Artificial Sequence
  source: /note="Description of Artificial Sequence: Synthetic oligonucleotide"
gttgtctccggctgagac

SEQ ID NO: 765 - DNA, 18 bp, Artificial Sequence
  source: /note="Description of Artificial Sequence: Synthetic oligonucleotide"
ctgttgtctccggctgag

SEQ ID NO: 766 - DNA, 18 bp, Artificial Sequence
  source: /note="Description of Artificial Sequence: Synthetic oligonucleotide"
ttctgttgtctccggctg

SEQ ID NO: 767 - DNA, 18 bp, Artificial Sequence
  source: /note="Description of Artificial Sequence: Synthetic oligonucleotide"
tcttctgttgtctccggc

SEQ ID NO: 768 - DNA, 18 bp, Artificial Sequence
  source: /note="Description of Artificial Sequence: Synthetic oligonucleotide"
gttcttctgttgtctccg

SEQ ID NO: 769 - DNA, 18 bp, Artificial Sequence
  source: /note="Description of Artificial Sequence: Synthetic oligonucleotide"
cggttcttctgttgtctc

SEQ ID NO: 770 - DNA, 18 bp, Artificial Sequence
  source: /note="Description of Artificial Sequence: Synthetic oligonucleotide"
agcggttcttctgttgtc

SEQ ID NO: 771 - DNA, 18 bp, Artificial Sequence
  source: /note="Description of Artificial Sequence: Synthetic oligonucleotide"
taagcggttcttctgttg

SEQ ID NO: 772 - DNA, 18 bp, Artificial Sequence
  source: /note="Description of Artificial Sequence: Synthetic oligonucleotide"
agtaagcggttcttctgt

SEQ ID NO: 773 - DNA, 18 bp, Artificial Sequence
  source: /note="Description of Artificial Sequence: Synthetic oligonucleotide"
tcagtaagcggttcttct

SEQ ID NO: 774 - DNA, 18 bp, Artificial Sequence
  source: /note="Description of Artificial Sequence: Synthetic oligonucleotide"
tttcagtaagcggttctt

SEQ ID NO: 775 - DNA, 18 bp, Artificial Sequence
  source: /note="Description of Artificial Sequence: Synthetic oligonucleotide"
agtttcagtaagcggttc

SEQ ID NO: 776 - DNA, 18 bp, Artificial Sequence
  source: /note="Description of Artificial Sequence: Synthetic oligonucleotide"
ggagtttcagtaagcggt

SEQ ID NO: 777 - DNA, 18 bp, Artificial Sequence
  source: /note="Description of Artificial Sequence: Synthetic oligonucleotide"
aaggagtttcagtaagcg

SEQ ID NO: 778 - DNA, 18 bp, Artificial Sequence
  source: /note="Description of Artificial Sequence: Synthetic oligonucleotide"
ccaaggagtttcagtaag

SEQ ID NO: 779 - DNA, 18 bp, Artificial Sequence
  source: /note="Description of Artificial Sequence: Synthetic oligonucleotide"
ccccaaggagtttcagta

SEQ ID NO: 780 - DNA, 18 bp, Artificial Sequence
  source: /note="Description of Artificial Sequence: Synthetic oligonucleotide"
acccccaaggagtttcag

SEQ ID NO: 781 - DNA, 18 bp, Artificial Sequence
  source: /note="Description of Artificial Sequence: Synthetic oligonucleotide"
gaacccccaaggagtttc

SEQ ID NO: 782 - DNA, 18 bp, Artificial Sequence
  source: /note="Description of Artificial Sequence: Synthetic oligonucleotide"
cagaacccccaaggagtt

SEQ ID NO: 783 - DNA, 18 bp, Artificial Sequence
  source: /note="Description of Artificial Sequence: Synthetic oligonucleotide"
atcagaacccccaaggag

SEQ ID NO: 784 - DNA, 18 bp, Artificial Sequence
  source: /note="Description of Artificial Sequence: Synthetic oligonucleotide"
gtatcagaacccccaagg

SEQ ID NO: 785 - DNA, 18 bp, Artificial Sequence
  source: /note="Description of Artificial Sequence: Synthetic oligonucleotide"
gtgtatcagaacccccaa

SEQ ID NO: 786 - DNA, 18 bp, Artificial Sequence
  source: /note="Description of Artificial Sequence: Synthetic oligonucleotide"
tagtgtatcagaaccccc

SEQ ID NO: 787 - DNA, 18 bp, Artificial Sequence
  source: /note="Description of Artificial Sequence: Synthetic oligonucleotide"
cctagtgtatcagaaccc

SEQ ID NO: 788 - DNA, 18 bp, Artificial Sequence
  source: /note="Description of Artificial Sequence: Synthetic oligonucleotide"
cccctagtgtatcagaac

SEQ ID NO: 789 - DNA, 18 bp, Artificial Sequence
  source: /note="Description of Artificial Sequence: Synthetic oligonucleotide"
tccccctagtgtatcaga

SEQ ID NO: 790 - DNA, 18 bp, Artificial Sequence
  source: /note="Description of Artificial Sequence: Synthetic oligonucleotide"
actccccctagtgtatca

SEQ ID NO: 791 - DNA, 18 bp, Artificial Sequence
  source: /note="Description of Artificial Sequence: Synthetic oligonucleotide"
aaactccccctagtgtat

SEQ ID NO: 792 - DNA, 18 bp, Artificial Sequence
  source: /note="Description of Artificial Sequence: Synthetic oligonucleotide"
taaaactccccctagtgt

SEQ ID NO: 793 - DNA, 18 bp, Artificial Sequence
  source: /note="Description of Artificial Sequence: Synthetic oligonucleotide"
cataaaactccccctagt

SEQ ID NO: 794 - DNA, 18 bp, Artificial Sequence
  source: /note="Description of Artificial Sequence: Synthetic oligonucleotide"
cccataaaactcccccta

SEQ ID NO: 795 - DNA, 18 bp, Artificial Sequence
  source: /note="Description of Artificial Sequence: Synthetic oligonucleotide"
ttcccataaaactccccc

SEQ ID NO: 796 - DNA, 18 bp, Artificial Sequence
  source: /note="Description of Artificial Sequence: Synthetic oligonucleotide"
ctttcccataaaactccc

SEQ ID NO: 797 - DNA, 18 bp, Artificial Sequence
  source: /note="Description of Artificial Sequence: Synthetic oligonucleotide"
ctctttcccataaaactc

SEQ ID NO: 798 - DNA, 18 bp, Artificial Sequence
  source: /note="Description of Artificial Sequence: Synthetic oligonucleotide"
tcctctttcccataaaac

SEQ ID NO: 799 - DNA, 18 bp, Artificial Sequence
  source: /note="Description of Artificial Sequence: Synthetic oligonucleotide"
cttcctctttcccataaa

SEQ ID NO: 800 - DNA, 18 bp, Artificial Sequence
  source: /note="Description of Artificial Sequence: Synthetic oligonucleotide"
tgcttcctctttcccata

SEQ ID NO: 801 - DNA, 18 bp, Artificial Sequence
  source: /note="Description of Artificial Sequence: Synthetic oligonucleotide"
actgcttcctctttccca

SEQ ID NO: 802 - DNA, 18 bp, Artificial Sequence
  source: /note="Description of Artificial Sequence: Synthetic oligonucleotide"
ttactgcttcctctttcc

SEQ ID NO: 803 - DNA, 18 bp, Artificial Sequence
  source: /note="Description of Artificial Sequence: Synthetic oligonucleotide"
aattactgcttcctcttt

SEQ ID NO: 804 - DNA, 18 bp, Artificial Sequence
  source: /note="Description of Artificial Sequence: Synthetic oligonucleotide"
gcaattactgcttcctct

SEQ ID NO: 805 - DNA, 18 bp, Artificial Sequence
  source: /note="Description of Artificial Sequence: Synthetic oligonucleotide"
ctgcaattactgcttcct

SEQ ID NO: 806 - DNA, 18 bp, Artificial Sequence
  source: /note="Description of Artificial Sequence: Synthetic oligonucleotide"
cactgcaattactgcttc

SEQ ID NO: 807 - DNA, 18 bp, Artificial Sequence
  source: /note="Description of Artificial Sequence: Synthetic oligonucleotide"
gtcactgcaattactgct

SEQ ID NO: 808 - DNA, 18 bp, Artificial Sequence
  source: /note="Description of Artificial Sequence: Synthetic oligonucleotide"
gcgtcactgcaattactg

SEQ ID NO: 809 - DNA, 18 bp, Artificial Sequence
  source: /note="Description of Artificial Sequence: Synthetic oligonucleotide"
gggcgtcactgcaattac

SEQ ID NO: 810 - DNA, 18 bp, Artificial Sequence
  source: /note="Description of Artificial Sequence: Synthetic oligonucleotide"
cggggcgtcactgcaatt

SEQ ID NO: 811 - DNA, 18 bp, Artificial Sequence
  source: /note="Description of Artificial Sequence: Synthetic oligonucleotide"
aacggggcgtcactgcaa

SEQ ID NO: 812 - DNA, 18 bp, Artificial Sequence
  source: /note="Description of Artificial Sequence: Synthetic oligonucleotide"
ctaacggggcgtcactgc

SEQ ID NO: 813 - DNA, 18 bp, Artificial Sequence
  source: /note="Description of Artificial Sequence: Synthetic oligonucleotide"
ttctaacggggcgtcact

SEQ ID NO: 814 - DNA, 18 bp, Artificial Sequence
  source: /note="Description of Artificial Sequence: Synthetic oligonucleotide"
ccttctaacggggcgtca

SEQ ID NO: 815 - DNA, 18 bp, Artificial Sequence
  source: /note="Description of Artificial Sequence: Synthetic oligonucleotide"
ccccttctaacggggcgt

SEQ ID NO: 816 - DNA, 18 bp, Artificial Sequence
  source: /note="Description of Artificial Sequence: Synthetic oligonucleotide"
agccccttctaacggggc

SEQ ID NO: 817 - DNA, 18 bp, Artificial Sequence
  source: /note="Description of Artificial Sequence: Synthetic oligonucleotide"
aaagccccttctaacggg

SEQ ID NO: 818 - DNA, 18 bp, Artificial Sequence
  source: /note="Description of Artificial Sequence: Synthetic oligonucleotide"
agaaagccccttctaacg

SEQ ID NO: 819 - DNA, 18 bp, Artificial Sequence
  source: /note="Description of Artificial Sequence: Synthetic oligonucleotide"
gtagaaagccccttctaa

SEQ ID NO: 820 - DNA, 18 bp, Artificial Sequence
  source: /note="Description of Artificial Sequence: Synthetic oligonucleotide"
aggtagaaagccccttct

SEQ ID NO: 821 - DNA, 18 bp, Artificial Sequence
  source: /note="Description of Artificial Sequence: Synthetic oligonucleotide"
ggaggtagaaagcccctt

SEQ ID NO: 822 - DNA, 18 bp, Artificial Sequence
  source: /note="Description of Artificial Sequence: Synthetic oligonucleotide"
ggggaggtagaaagcccc

SEQ ID NO: 823 - DNA, 18 bp, Artificial Sequence
  source: /note="Description of Artificial Sequence: Synthetic oligonucleotide"
ctggggaggtagaaagcc

SEQ ID NO: 824 - DNA, 18 bp, Artificial Sequence
  source: /note="Description of Artificial Sequence: Synthetic oligonucleotide"
tgctggggaggtagaaag

SEQ ID NO: 825 - DNA, 18 bp, Artificial Sequence
  source: /note="Description of Artificial Sequence: Synthetic oligonucleotide"
aatgctggggaggtagaa

SEQ ID NO: 826 - DNA, 18 bp, Artificial Sequence
  source: /note="Description of Artificial Sequence: Synthetic oligonucleotide"
ggaatgctggggaggtag

SEQ ID NO: 827 - DNA, 18 bp, Artificial Sequence
  source: /note="Description of Artificial Sequence: Synthetic oligonucleotide"
ggggaatgctggggaggt

SEQ ID NO: 828 - DNA, 18 bp, Artificial Sequence
  source: /note="Description of Artificial Sequence: Synthetic oligonucleotide"
tgggggaatgctggggag

SEQ ID NO: 829 - DNA, 18 bp, Artificial Sequence
  source: /note="Description of Artificial Sequence: Synthetic oligonucleotide"
tttgggggaatgctgggg

SEQ ID NO: 830 - DNA, 18 bp, Artificial Sequence
  source: /note="Description of Artificial Sequence: Synthetic oligonucleotide"
gctttgggggaatgctgg

SEQ ID NO: 831 - DNA, 18 bp, Artificial Sequence
  source: /note="Description of Artificial Sequence: Synthetic oligonucleotide"
ctgctttgggggaatgct

SEQ ID NO: 832 - DNA, 18 bp, Artificial Sequence
  source: /note="Description of Artificial Sequence: Synthetic oligonucleotide"
ccctgctttgggggaatg

SEQ ID NO: 833 - DNA, 18 bp, Artificial Sequence
  source: /note="Description of Artificial Sequence: Synthetic oligonucleotide"
gtccctgctttgggggaa

SEQ ID NO: 834 - DNA, 18 bp, Artificial Sequence
  source: /note="Description of Artificial Sequence: Synthetic oligonucleotide"
tggtccctgctttggggg

SEQ ID NO: 835 - DNA, 18 bp, Artificial Sequence
  source: /note="Description of Artificial Sequence: Synthetic oligonucleotide"
tgtggtccctgctttggg

SEQ ID NO: 836 - DNA, 18 bp, Artificial Sequence
  source: /note="Description of Artificial Sequence: Synthetic oligonucleotide"
ggtgtggtccctgctttg

SEQ ID NO: 837 - DNA, 18 bp, Artificial Sequence
  source: /note="Description of Artificial Sequence: Synthetic oligonucleotide"
atggtgtggtccctgctt

SEQ ID NO: 838 - DNA, 18 bp, Artificial Sequence
  source: /note="Description of Artificial Sequence: Synthetic oligonucleotide"
gaatggtgtggtccctgc

SEQ ID NO: 839 - DNA, 18 bp, Artificial Sequence
  source: /note="Description of Artificial Sequence: Synthetic oligonucleotide"
agaatggtgtggtccctg

SEQ ID NO: 840 - DNA, 16 bp, Artificial Sequence
  source: /note="Description of Artificial Sequence: Synthetic oligonucleotide"
gaatggtgtggtccct

SEQ ID NO: 841 - DNA, 18 bp, Artificial Sequence
  source: /note="Description of Artificial Sequence: Synthetic oligonucleotide"
aagaatggtgtggtccct

SEQ ID NO: 842 - DNA, 18 bp, Artificial Sequence
  source: /note="Description of Artificial Sequence: Synthetic oligonucleotide"
caagaatggtgtggtccc

SEQ ID NO: 843 - DNA, 18 bp, Artificial Sequence
  source: /note="Description of Artificial Sequence: Synthetic oligonucleotide"
tcaagaatggtgtggtcc

SEQ ID NO: 844 - DNA, 16 bp, Artificial Sequence
  source: /note="Description of Artificial Sequence: Synthetic oligonucleotide"
caagaatggtgtggtc

SEQ ID NO: 845 - DNA, 18 bp, Artificial Sequence
  source: /note="Description of Artificial Sequence: Synthetic oligonucleotide"
gtcaagaatggtgtggtc

SEQ ID NO: 846 - DNA, 18 bp, Artificial Sequence
  source: /note="Description of Artificial Sequence: Synthetic oligonucleotide"
ggtcaagaatggtgtggt

SEQ ID NO: 847 - DNA, 18 bp, Artificial Sequence
  source: /note="Description of Artificial Sequence: Synthetic oligonucleotide"
gggtcaagaatggtgtgg

SEQ ID NO: 848 - DNA, 16 bp, Artificial Sequence
  source: /note="Description of Artificial Sequence: Synthetic oligonucleotide"
ggtcaagaatggtgtg

SEQ ID NO: 849 - DNA, 18 bp, Artificial Sequence
  source: /note="Description of Artificial Sequence: Synthetic oligonucleotide"
tgggtcaagaatggtgtg

SEQ ID NO: 850 - DNA, 18 bp, Artificial Sequence
  source: /note="Description of Artificial Sequence: Synthetic oligonucleotide"
gctgggtcaagaatggtg

SEQ ID NO: 851 - DNA, 18 bp, Artificial Sequence
  source: /note="Description of Artificial Sequence: Synthetic oligonucleotide"
gagctgggtcaagaatgg

SEQ ID NO: 852 - DNA, 18 bp, Artificial Sequence
  source: /note="Description of Artificial Sequence: Synthetic oligonucleotide"
tggagctgggtcaagaat

SEQ ID NO: 853 - DNA, 18 bp, Artificial Sequence
  source: /note="Description of Artificial Sequence: Synthetic oligonucleotide"
ggtggagctgggtcaaga

SEQ ID NO: 854 - DNA, 18 bp, Artificial Sequence
  source: /note="Description of Artificial Sequence: Synthetic oligonucleotide"
ggggtggagctgggtcaa

SEQ ID NO: 855 - DNA, 18 bp, Artificial Sequence
  source: /note="Description of Artificial Sequence: Synthetic oligonucleotide"
caggggtggagctgggtc

SEQ ID NO: 856 - DNA, 18 bp, Artificial Sequence
  source: /note="Description of Artificial Sequence: Synthetic oligonucleotide"
gacaggggtggagctggg

SEQ ID NO: 857 - DNA, 18 bp, Artificial Sequence
  source: /note="Description of Artificial Sequence: Synthetic oligonucleotide"
ccgacaggggtggagctg

SEQ ID NO: 858 - DNA, 18 bp, Artificial Sequence
  source: /note="Description of Artificial Sequence: Synthetic oligonucleotide"
taccgacaggggtggagc

SEQ ID NO: 859 - DNA, 18 bp, Artificial Sequence
  source: /note="Description of Artificial Sequence: Synthetic oligonucleotide"
cctaccgacaggggtgga

SEQ ID NO: 860 - DNA, 18 bp, Artificial Sequence
  source: /note="Description of Artificial Sequence: Synthetic oligonucleotide"
cacctaccgacaggggtg

SEQ ID NO: 861 - DNA, 18 bp, Artificial Sequence
  source: /note="Description of Artificial Sequence: Synthetic oligonucleotide"
agcacctaccgacagggg

SEQ ID NO: 862 - DNA, 18 bp, Artificial Sequence
  source: /note="Description of Artificial Sequence: Synthetic oligonucleotide"
ccagcacctaccgacagg

SEQ ID NO: 863 - DNA, 18 bp, Artificial Sequence
  source: /note="Description of Artificial Sequence: Synthetic oligonucleotide"
agccagcacctaccgaca

SEQ ID NO: 864 - DNA, 18 bp, Artificial Sequence
  source: /note="Description of Artificial Sequence: Synthetic oligonucleotide"
gaagccagcacctaccga

SEQ ID NO: 865 - DNA, 18 bp, Artificial Sequence
  source: /note="Description of Artificial Sequence: Synthetic oligonucleotide"
aagaagccagcacctacc

SEQ ID NO: 866 - DNA, 18 bp, Artificial Sequence
  source: /note="Description of Artificial Sequence: Synthetic oligonucleotide"
ggaagaagccagcaccta

SEQ ID NO: 867 - DNA, 18 bp, Artificial Sequence
  source: /note="Description of Artificial Sequence: Synthetic oligonucleotide"
ggggaagaagccagcacc

SEQ ID NO: 868 - DNA, 18 bp, Artificial Sequence
  source: /note="Description of Artificial Sequence: Synthetic oligonucleotide"
gaggggaagaagccagca

SEQ ID NO: 869 - DNA, 18 bp, Artificial Sequence
  source: /note="Description of Artificial Sequence: Synthetic oligonucleotide"
gagaggggaagaagccag

SEQ ID NO: 870 - DNA, 18 bp, Artificial Sequence
  source: /note="Description of Artificial Sequence: Synthetic oligonucleotide"
aggagaggggaagaagcc

SEQ ID NO: 871 - DNA, 18 bp, Artificial Sequence
  source: /note="Description of Artificial Sequence: Synthetic oligonucleotide"
ccaggagaggggaagaag

SEQ ID NO: 872 - DNA, 18 bp, Artificial Sequence
  source: /note="Description of Artificial Sequence: Synthetic oligonucleotide"
caccaggagaggggaaga

SEQ ID NO: 873 - DNA, 18 bp, Artificial Sequence
  source: /note="Description of Artificial Sequence: Synthetic oligonucleotide"
accaccaggagaggggaa

SEQ ID NO: 874 - DNA, 18 bp, Artificial Sequence
  source: /note="Description of Artificial Sequence: Synthetic oligonucleotide"
ccaccaccaggagagggg

SEQ ID NO: 875 - DNA, 18 bp, Artificial Sequence
  source: /note="Description of Artificial Sequence: Synthetic oligonucleotide"
caccaccaccaggagagg

SEQ ID NO: 876 - DNA, 18 bp, Artificial Sequence
  source: /note="Description of Artificial Sequence: Synthetic oligonucleotide"
cccaccaccaccaggaga

SEQ ID NO: 877 - DNA, 18 bp, Artificial Sequence
  source: /note="Description of Artificial Sequence: Synthetic oligonucleotide"
cacccaccaccaccagga

SEQ ID NO: 878 - DNA, 18 bp, Artificial Sequence
  source: /note="Description of Artificial Sequence: Synthetic oligonucleotide"
accacccaccaccaccag

SEQ ID NO: 879 - DNA, 18 bp, Artificial Sequence
  source: /note="Description of Artificial Sequence: Synthetic oligonucleotide"
gaaccacccaccaccacc

SEQ ID NO: 880 - DNA, 18 bp, Artificial Sequence
  source: /note="Description of Artificial Sequence: Synthetic oligonucleotide"
gggaaccacccaccacca

SEQ ID NO: 881 - DNA, 18 bp, Artificial Sequence
  source: /note="Description of Artificial Sequence: Synthetic oligonucleotide"
gcgggaaccacccaccac

SEQ ID NO: 882 - DNA, 18 bp, Artificial Sequence
  source: /note="Description of Artificial Sequence: Synthetic oligonucleotide"
cctcctgtttaccctaaa

SEQ ID NO: 883 - DNA, 18 bp, Artificial Sequence
  source: /note="Description of Artificial Sequence: Synthetic oligonucleotide"
cccctcctgtttacccta

SEQ ID NO: 884 - DNA, 18 bp, Artificial Sequence
  source: /note="Description of Artificial Sequence: Synthetic oligonucleotide"
ggcccctcctgtttaccc

SEQ ID NO: 885 - DNA, 18 bp, Artificial Sequence
  source: /note="Description of Artificial Sequence: Synthetic oligonucleotide"
gtggcccctcctgtttac

SEQ ID NO: 886 - DNA, 18 bp, Artificial Sequence
  source: /note="Description of Artificial Sequence: Synthetic oligonucleotide"
atgtggcccctcctgttt

SEQ ID NO: 887 - DNA, 18 bp, Artificial Sequence
  source: /note="Description of Artificial Sequence: Synthetic oligonucleotide"
gcatgtggcccctcctgt

SEQ ID NO: 888 - DNA, 18 bp, Artificial Sequence
  source: /note="Description of Artificial Sequence: Synthetic oligonucleotide"
gtgcatgtggcccctcct

SEQ ID NO: 889 - DNA, 18 bp, Artificial Sequence
  source: /note="Description of Artificial Sequence: Synthetic oligonucleotide"
ctgtgcatgtggcccctc

SEQ ID NO: 890 - DNA, 18 bp, Artificial Sequence
  source: /note="Description of Artificial Sequence: Synthetic oligonucleotide"
acctgtgcatgtggcccc

SEQ ID NO: 891 - DNA, 18 bp, Artificial Sequence
  source: /note="Description of Artificial Sequence: Synthetic oligonucleotide"
ttacctgtgcatgtggcc

SEQ ID NO: 892 - DNA, 18 bp, Artificial Sequence
  source: /note="Description of Artificial Sequence: Synthetic oligonucleotide"
aattacctgtgcatgtgg

SEQ ID NO: 893 - DNA, 18 bp, Artificial Sequence
  source: /note="Description of Artificial Sequence: Synthetic oligonucleotide"
tgaattacctgtgcatgt

SEQ ID NO: 894 - DNA, 18 bp, Artificial Sequence
  source: /note="Description of Artificial Sequence: Synthetic oligonucleotide"
ggtgaattacctgtgcat

SEQ ID NO: 895 - DNA, 18 bp, Artificial Sequence
  source: /note="Description of Artificial Sequence: Synthetic oligonucleotide"
ctggtgaattacctgtgc

SEQ ID NO: 896 - DNA, 18 bp, Artificial Sequence
  source: /note="Description of Artificial Sequence: Synthetic oligonucleotide"
ccctggtgaattacctgt

SEQ ID NO: 897 - DNA, 18 bp, Artificial Sequence
  source: /note="Description of Artificial Sequence: Synthetic oligonucleotide"
ctccctggtgaattacct

SEQ ID NO: 898 - DNA, 18 bp, Artificial Sequence
  source: /note="Description of Artificial Sequence: Synthetic oligonucleotide"
ggctccctggtgaattac

SEQ ID NO: 899 - DNA, 18 bp, Artificial Sequence
  source: /note="Description of Artificial Sequence: Synthetic oligonucleotide"
tcggctccctggtgaatt

SEQ ID NO: 900 - DNA, 18 bp, Artificial Sequence
  source: /note="Description of Artificial Sequence: Synthetic oligonucleotide"
gttcggctccctggtgaa

SEQ ID NO: 901 - DNA, 18 bp, Artificial Sequence
  source: /note="Description of Artificial Sequence: Synthetic oligonucleotide"
gtgttcggctccctggtg

SEQ ID NO: 902 - DNA, 18 bp, Artificial Sequence
  source: /note="Description of Artificial Sequence: Synthetic oligonucleotide"
gagtgttcggctccctgg

SEQ ID NO: 903 - DNA, 18 bp, Artificial Sequence
  source: /note="Description of Artificial Sequence: Synthetic oligonucleotide"
aggagtgttcggctccct

SEQ ID NO: 904 - DNA, 18 bp, Artificial Sequence
  source: /note="Description of Artificial Sequence: Synthetic oligonucleotide"
acaggagtgttcggctcc

SEQ ID NO: 905 - DNA, 18 bp, Artificial Sequence
  source: /note="Description of Artificial Sequence: Synthetic oligonucleotide"
gcacaggagtgttcggct

SEQ ID NO: 906 - DNA, 18 bp, Artificial Sequence
  source: /note="Description of Artificial Sequence: Synthetic oligonucleotide"
tggataccactgcggggg

SEQ ID NO: 907 - DNA, 18 bp, Artificial Sequence
  source: /note="Description of Artificial Sequence: Synthetic oligonucleotide"
tgtggataccactgcggg

SEQ ID NO: 908 - DNA, 18 bp, Artificial Sequence
  source: /note="Description of Artificial Sequence: Synthetic oligonucleotide"
ggtgtggataccactgcg

SEQ ID NO: 909 - DNA, 18 bp, Artificial Sequence
  source: /note="Description of Artificial Sequence: Synthetic oligonucleotide"
tgggaatggtgcaacagg

SEQ ID NO: 910 - DNA, 18 bp, Artificial Sequence
  source: /note="Description of Artificial Sequence: Synthetic oligonucleotide"
cctgggaatggtgcaaca

SEQ ID NO: 911 - DNA, 18 bp, Artificial Sequence
  source: /note="Description of Artificial Sequence: Synthetic oligonucleotide"
tgcctgggaatggtgcaa

SEQ ID NO: 912 - DNA, 18 bp, Artificial Sequence
  source: /note="Description of Artificial Sequence: Synthetic oligonucleotide"
agtgcctgggaatggtgc

SEQ ID NO: 913 - DNA, 18 bp, Artificial Sequence
  source: /note="Description of Artificial Sequence: Synthetic oligonucleotide"
acacctataacacgtcac

SEQ ID NO: 914 - DNA, 18 bp, Artificial Sequence
  source: /note="Description of Artificial Sequence: Synthetic oligonucleotide"
ggacacctataacacgtc

SEQ ID NO: 915 - DNA, 18 bp, Artificial Sequence
  source: /note="Description of Artificial Sequence: Synthetic oligonucleotide"
agggacacctataacacg

SEQ ID NO: 916 - DNA, 18 bp, Artificial Sequence
  source: /note="Description of Artificial Sequence: Synthetic oligonucleotide"
cagccgacatgtcatttc

SEQ ID NO: 917 - DNA, 18 bp, Artificial Sequence
  source: /note="Description of Artificial Sequence: Synthetic oligonucleotide"
cccagccgacatgtcatt

SEQ ID NO: 918 - DNA, 18 bp, Artificial Sequence
  source: /note="Description of Artificial Sequence: Synthetic oligonucleotide"
cgcccagccgacatgtca

SEQ ID NO: 919 - DNA, 18 bp, Artificial Sequence
  source: /note="Description of Artificial Sequence: Synthetic oligonucleotide"
cacgcccagccgacatgt

SEQ ID NO: 920 - DNA, 18 bp, Artificial Sequence
  source: /note="Description of Artificial Sequence: Synthetic oligonucleotide"
accacgcccagccgacat

SEQ ID NO: 921 - DNA, 18 bp, Artificial Sequence
  source: /note="Description of Artificial Sequence: Synthetic oligonucleotide"
atggcatttctttttctt

SEQ ID NO: 922 - DNA, 18 bp, Artificial Sequence
  source: /note="Description of Artificial Sequence: Synthetic oligonucleotide"
acatggcatttctttttc

SEQ ID NO: 923 - DNA, 18 bp, Artificial Sequence
  source: /note="Description of Artificial Sequence: Synthetic oligonucleotide"
ttacatggcatttctttt

SEQ ID NO: 924 - DNA, 18 bp, Artificial Sequence
  source: /note="Description of Artificial Sequence: Synthetic oligonucleotide"
atttacatggcatttctt

SEQ ID NO: 925 - DNA, 18 bp, Artificial Sequence
  source: /note="Description of Artificial Sequence: Synthetic oligonucleotide"
ggcttacgatgggtgcat

SEQ ID NO: 926 - DNA, 18 bp, Artificial Sequence
  source: /note="Description of Artificial Sequence: Synthetic oligonucleotide"
taggcttacgatgggtgc

SEQ ID NO: 927 - DNA, 18 bp, Artificial Sequence
  source: /note="Description of Artificial Sequence: Synthetic oligonucleotide"
gttaggcttacgatgggt

SEQ ID NO: 928 - DNA, 18 bp, Artificial Sequence
  source: /note="Description of Artificial Sequence: Synthetic oligonucleotide"
tagttaggcttacgatgg

SEQ ID NO: 929 - DNA, 18 bp, Artificial Sequence
  source: /note="Description of Artificial Sequence: Synthetic oligonucleotide"
aaaaaacccctgaaaatg

SEQ ID NO: 930 - DNA, 18 bp, Artificial Sequence
  source: /note="Description of Artificial Sequence: Synthetic oligonucleotide"
caaaaaaacccctgaaaa

SEQ ID NO: 931 - DNA, 18 bp, Artificial Sequence
  source: /note="Description of Artificial Sequence: Synthetic oligonucleotide"
aacaaaaaaacccctgaa

SEQ ID NO: 932 - DNA, 18 bp, Artificial Sequence
  source: /note="Description of Artificial Sequence: Synthetic oligonucleotide"
atatattgggcgcggtgg

SEQ ID NO: 933 - DNA, 18 bp, Artificial Sequence
  source: /note="Description of Artificial Sequence: Synthetic oligonucleotide"
aaatatattgggcgcggt

SEQ ID NO: 934 - DNA, 18 bp, Artificial Sequence
  source: /note="Description of Artificial Sequence: Synthetic oligonucleotide"
caaaatatattgggcgcg

SEQ ID NO: 935 - DNA, 18 bp, Artificial Sequence
  source: /note="Description of Artificial Sequence: Synthetic oligonucleotide"
atcaaaatatattgggcg

SEQ ID NO: 936 - DNA, 18 bp, Artificial Sequence
  source: /note="Description of Artificial Sequence: Synthetic oligonucleotide"
taagtacagtcagccctc

SEQ ID NO: 937 - DNA, 18 bp, Artificial Sequence
  source: /note="Description of Artificial Sequence: Synthetic oligonucleotide"
gttaagtacagtcagccc

SEQ ID NO: 938 - DNA, 18 bp, Artificial Sequence
  source: /note="Description of Artificial Sequence: Synthetic oligonucleotide"
atgttaagtacagtcagc

SEQ ID NO: 939 - DNA, 18 bp, Artificial Sequence
  source: /note="Description of Artificial Sequence: Synthetic oligonucleotide"
cagccacacctttatttt

SEQ ID NO: 940 - DNA, 18 bp, Artificial Sequence
  source: /note="Description of Artificial Sequence: Synthetic oligonucleotide"
cccagccacacctttatt

SEQ ID NO: 941 - DNA, 18 bp, Artificial Sequence
  source: /note="Description of Artificial Sequence: Synthetic oligonucleotide"
cacccagccacaccttta

SEQ ID NO: 942 - DNA, 18 bp, Artificial Sequence
  source: /note="Description of Artificial Sequence: Synthetic oligonucleotide"
cacacccagccacacctt

SEQ ID NO: 943 - DNA, 18 bp, Artificial Sequence
  source: /note="Description of Artificial Sequence: Synthetic oligonucleotide"
accacacccagccacacc

SEQ ID NO: 944 - DNA, 18 bp, Artificial Sequence
  source: /note="Description of Artificial Sequence: Synthetic oligonucleotide"
tcaccccctttttttttt

SEQ ID NO: 945 - DNA, 18 bp, Artificial Sequence
  source: /note="Description of Artificial Sequence: Synthetic oligonucleotide"
gctcaccccctttttttt

SEQ ID NO: 946 - DNA, 18 bp, Artificial Sequence
  source: /note="Description of Artificial Sequence: Synthetic oligonucleotide"
ctgctcaccccctttttt

SEQ ID NO: 947 - DNA, 18 bp, Artificial Sequence
  source: /note="Description of Artificial Sequence: Synthetic oligonucleotide"
gtctgctcaccccctttt

SEQ ID NO: 948 - DNA, 18 bp, Artificial Sequence
  source: /note="Description of Artificial Sequence: Synthetic oligonucleotide"
acgtctgctcaccccctt

SEQ ID NO: 949 - DNA, 18 bp, Artificial Sequence
  source: /note="Description of Artificial Sequence: Synthetic oligonucleotide"
ccacgtctgctcaccccc

SEQ ID NO: 950 - DNA, 18 bp, Artificial Sequence
  source: /note="Description of Artificial Sequence: Synthetic oligonucleotide"
caccacgtctgctcaccc

SEQ ID NO: 951 - DNA, 18 bp, Artificial Sequence
  source: /note="Description of Artificial Sequence: Synthetic oligonucleotide"
ctttacttttattttatt

SEQ ID NO: 952 - DNA, 18 bp, Artificial Sequence
  source: /note="Description of Artificial Sequence: Synthetic oligonucleotide"
acctttacttttatttta

SEQ ID NO: 953 - DNA, 18 bp, Artificial Sequence
  source: /note="Description of Artificial Sequence: Synthetic oligonucleotide"
atacctttacttttattt

SEQ ID NO: 954 - DNA, 18 bp, Artificial Sequence
  source: /note="Description of Artificial Sequence: Synthetic oligonucleotide"
taatacctttacttttat

SEQ ID NO: 955 - DNA, 18 bp, Artificial Sequence
  source: /note="Description of Artificial Sequence: Synthetic oligonucleotide"
aaacagtaatgtctgttg

SEQ ID NO: 956 - DNA, 18 bp, Artificial Sequence
  source: /note="Description of Artificial Sequence: Synthetic oligonucleotide"
aaaaacagtaatgtctgt

SEQ ID NO: 957 - DNA, 18 bp, Artificial Sequence
  source: /note="Description of Artificial Sequence: Synthetic oligonucleotide"
gcaaaaacagtaatgtct

SEQ ID NO: 958 - DNA, 18 bp, Artificial Sequence
  source: /note="Description of Artificial Sequence: Synthetic oligonucleotide"
aagcaaaaacagtaatgt

SEQ ID NO: 959 - DNA, 18 bp, Artificial Sequence
  source: /note="Description of Artificial Sequence: Synthetic oligonucleotide"
ttaagcccacgccaccct

SEQ ID NO: 960 - DNA, 18 bp, Artificial Sequence
  source: /note="Description of Artificial Sequence: Synthetic oligonucleotide"
gcttaagcccacgccacc

SEQ ID NO: 961 - DNA, 18 bp, Artificial Sequence
  source: /note="Description of Artificial Sequence: Synthetic oligonucleotide"
ctgcttaagcccacgcca

SEQ ID NO: 962 - DNA, 18 bp, Artificial Sequence
  source: /note="Description of Artificial Sequence: Synthetic oligonucleotide"
aactgcttaagcccacgc

SEQ ID NO: 963 - DNA, 18 bp, Artificial Sequence
  source: /note="Description of Artificial Sequence: Synthetic oligonucleotide"
gcaactgcttaagcccac

SEQ ID NO: 964 - DNA, 18 bp, Artificial Sequence
  source: /note="Description of Artificial Sequence: Synthetic oligonucleotide"
tggcaactgcttaagccc

SEQ ID NO: 965 - DNA, 18 bp, Artificial Sequence
  source: /note="Description of Artificial Sequence: Synthetic oligonucleotide"
tctggcaactgcttaagc

SEQ ID NO: 966 - DNA, 18 bp, Artificial Sequence
  source: /note="Description of Artificial Sequence: Synthetic oligonucleotide"
cgtctggcaactgcttaa

SEQ ID NO: 967 - DNA, 18 bp, Artificial Sequence
  source: /note="Description of Artificial Sequence: Synthetic oligonucleotide"
aacgtctggcaactgctt

SEQ ID NO: 968 - DNA, 18 bp, Artificial Sequence
  source: /note="Description of Artificial Sequence: Synthetic oligonucleotide"
ggaacgtctggcaactgc

SEQ ID NO: 969 - DNA, 18 bp, Artificial Sequence
  source: /note="Description of Artificial Sequence: Synthetic oligonucleotide"
aaggaacgtctggcaact

SEQ ID NO: 970 - DNA, 18 bp, Artificial Sequence
  source: /note="Description of Artificial Sequence: Synthetic oligonucleotide"
ccaaggaacgtctggcaa

SEQ ID NO: 971 - DNA, 18 bp, Artificial Sequence
  source: /note="Description of Artificial Sequence: Synthetic oligonucleotide"
taccaaggaacgtctggc

SEQ ID NO: 972 - DNA, 18 bp, Artificial Sequence
  source: /note="Description of Artificial Sequence: Synthetic oligonucleotide"
agtaccaaggaacgtctg

SEQ ID NO: 973 - DNA, 18 bp, Artificial Sequence
  source: /note="Description of Artificial Sequence: Synthetic oligonucleotide"
aaagtaccaaggaacgtc

SEQ ID NO: 974 - DNA, 18 bp, Artificial Sequence
  source: /note="Description of Artificial Sequence: Synthetic oligonucleotide"
gcaaagtaccaaggaacg

SEQ ID NO: 975 - DNA, 18 bp, Artificial Sequence
  source: /note="Description of Artificial Sequence: Synthetic oligonucleotide"
ctgcaaagtaccaaggaa

SEQ ID NO: 976 - DNA, 18 bp, Artificial Sequence
  source: /note="Description of Artificial Sequence: Synthetic oligonucleotide"
agctcaccagggtccaca

SEQ ID NO: 977 - DNA, 18 bp, Artificial Sequence
  source: /note="Description of Artificial Sequence: Synthetic oligonucleotide"
ccagctcaccagggtcca

SEQ ID NO: 978 - DNA, 18 bp, Artificial Sequence
  source: /note="Description of Artificial Sequence: Synthetic oligonucleotide"
acccagctcaccagggtc

SEQ ID NO: 979 - DNA, 18 bp, Artificial Sequence
  source: /note="Description of Artificial Sequence: Synthetic oligonucleotide"
ccacccagctcaccaggg

SEQ ID NO: 980 - DNA, 18 bp, Artificial Sequence
  source: /note="Description of Artificial Sequence: Synthetic oligonucleotide"
ggccacccagctcaccag

SEQ ID NO: 981 - DNA, 18 bp, Artificial Sequence
  source: /note="Description of Artificial Sequence: Synthetic oligonucleotide"
aaggccacccagctcacc

SEQ ID NO: 982 - DNA, 18 bp, Artificial Sequence
  source: /note="Description of Artificial Sequence: Synthetic oligonucleotide"
ttaaggccacccagctca

SEQ ID NO: 983 - DNA, 18 bp, Artificial Sequence
  source: /note="Description of Artificial Sequence: Synthetic oligonucleotide"
tgttaaggccacccagct

SEQ ID NO: 984 - DNA, 18 bp, Artificial Sequence
  source: /note="Description of Artificial Sequence: Synthetic oligonucleotide"
gctgttaaggccacccag

SEQ ID NO: 985 - DNA, 18 bp, Artificial Sequence
  source: /note="Description of Artificial Sequence: Synthetic oligonucleotide"
ctgctgttaaggccaccc

SEQ ID NO: 986 - DNA, 18 bp, Artificial Sequence
  source: /note="Description of Artificial Sequence: Synthetic oligonucleotide"
ccctgctgttaaggccac

SEQ ID NO: 987 - DNA, 18 bp, Artificial Sequence
  source: /note="Description of Artificial Sequence: Synthetic oligonucleotide"
agccctgctgttaaggcc

SEQ ID NO: 988 - DNA, 18 bp, Artificial Sequence
  source: /note="Description of Artificial Sequence: Synthetic oligonucleotide"
ccagccctgctgttaagg

SEQ ID NO: 989 - DNA, 18 bp, Artificial Sequence
  source: /note="Description of Artificial Sequence: Synthetic oligonucleotide"
caccagccctgctgttaa

SEQ ID NO: 990 - DNA, 18 bp, Artificial Sequence
  source: /note="Description of Artificial Sequence: Synthetic oligonucleotide"
gccaccagccctgctgtt

SEQ ID NO: 991 - DNA, 18 bp, Artificial Sequence
  source: /note="Description of Artificial Sequence: Synthetic oligonucleotide"
cagccaccagccctgctg

SEQ ID NO: 992 - DNA, 18 bp, Artificial Sequence
  source: /note="Description of Artificial Sequence: Synthetic oligonucleotide"
tccagccaccagccctgc

SEQ ID NO: 993 - DNA, 18 bp, Artificial Sequence
  source: /note="Description of Artificial Sequence: Synthetic oligonucleotide"
gttccagccaccagccct

SEQ ID NO: 994 - DNA, 18 bp, Artificial Sequence
  source: /note="Description of Artificial Sequence: Synthetic oligonucleotide"
gcgttccagccaccagcc

SEQ ID NO: 995 - DNA, 18 bp, Artificial Sequence
  source: /note="Description of Artificial Sequence: Synthetic oligonucleotide"
ccgcgttccagccaccag

SEQ ID NO: 996 - DNA, 18 bp, Artificial Sequence
  source: /note="Description of Artificial Sequence: Synthetic oligonucleotide"
caccgcgttccagccacc

SEQ ID NO: 997 - DNA, 18 bp, Artificial Sequence
  source: /note="Description of Artificial Sequence: Synthetic oligonucleotide"
ggcaccgcgttccagcca

SEQ ID NO: 998 - DNA, 18 bp, Artificial Sequence
  source: /note="Description of Artificial Sequence: Synthetic oligonucleotide"
tgggcaccgcgttccagc

SEQ ID NO: 999 - DNA, 18 bp, Artificial Sequence
  source: /note="Description of Artificial Sequence: Synthetic oligonucleotide"
tctgggcaccgcgttcca

SEQ ID NO: 1000 - DNA, 18 bp, Artificial Sequence
  source: /note="Description of Artificial Sequence: Synthetic oligonucleotide"
catctgggcaccgcgttc

SEQ ID NO: 1001 - DNA, 18 bp, Artificial Sequence
  source: /note="Description of Artificial Sequence: Synthetic oligonucleotide"
accatctgggcaccgcgt

SEQ ID NO: 1002 - DNA, 18 bp, Artificial Sequence
  source: /note="Description of Artificial Sequence: Synthetic oligonucleotide"
tgaccatctgggcaccgc

SEQ ID NO: 1003 - DNA, 18 bp, Artificial Sequence
  source: /note="Description of Artificial Sequence: Synthetic oligonucleotide"
actgaccatctgggcacc

SEQ ID NO: 1004 - DNA, 18 bp, Artificial Sequence
  source: /note="Description of Artificial Sequence: Synthetic oligonucleotide"
gaactgaccatctgggca

SEQ ID NO: 1005 - DNA, 18 bp, Artificial Sequence
  source: /note="Description of Artificial Sequence: Synthetic oligonucleotide"
cagaactgaccatctggg

SEQ ID NO: 1006 - DNA, 18 bp, Artificial Sequence
  source: /note="Description of Artificial Sequence: Synthetic oligonucleotide"
ggcagaactgaccatctg

SEQ ID NO: 1007 - DNA, 18 bp, Artificial Sequence
  source: /note="Description of Artificial Sequence: Synthetic oligonucleotide"
agggcagaactgaccatc

SEQ ID NO: 1008 - DNA, 18 bp, Artificial Sequence
  source: /note="Description of Artificial Sequence: Synthetic oligonucleotide"
acagggcagaactgacca

SEQ ID NO: 1009 - DNA, 18 bp, Artificial Sequence
  source: /note="Description of Artificial Sequence: Synthetic oligonucleotide"
ccacagggcagaactgac

SEQ ID NO: 1010 - DNA, 18 bp, Artificial Sequence
  source: /note="Description of Artificial Sequence: Synthetic oligonucleotide"
ggccacagggcagaactg

SEQ ID NO: 1011 - DNA, 18 bp, Artificial Sequence
  source: /note="Description of Artificial Sequence: Synthetic oligonucleotide"
caggccacagggcagaac

SEQ ID NO: 1012 - DNA, 18 bp, Artificial Sequence
  source: /note="Description of Artificial Sequence: Synthetic oligonucleotide"
agcaggccacagggcaga

SEQ ID NO: 1013 - DNA, 18 bp, Artificial Sequence
  source: /note="Description of Artificial Sequence: Synthetic oligonucleotide"
gcagcaggccacagggca

SEQ ID NO: 1014 - DNA, 18 bp, Artificial Sequence
  source: /note="Description of Artificial Sequence: Synthetic oligonucleotide"
aggcagcaggccacaggg

SEQ ID NO: 1015 - DNA, 18 bp, Artificial Sequence
  source: /note="Description of Artificial Sequence: Synthetic oligonucleotide"
ccaggcagcaggccacag

SEQ ID NO: 1016 - DNA, 18 bp, Artificial Sequence
  source: /note="Description of Artificial Sequence: Synthetic oligonucleotide"
gtccaggcagcaggccac

SEQ ID NO: 1017 - DNA, 18 bp, Artificial Sequence
  source: /note="Description of Artificial Sequence: Synthetic oligonucleotide"
gggtccaggcagcaggcc

SEQ ID NO: 1018 - DNA, 18 bp, Artificial Sequence
  source: /note="Description of Artificial Sequence: Synthetic oligonucleotide"
cggggtccaggcagcagg

SEQ ID NO: 1019 - DNA, 18 bp, Artificial Sequence
  source: /note="Description of Artificial Sequence: Synthetic oligonucleotide"
tccggggtccaggcagca

SEQ ID NO: 1020 - DNA, 18 bp, Artificial Sequence
  source: /note="Description of Artificial Sequence: Synthetic oligonucleotide"
cctccggggtccaggcag

SEQ ID NO: 1021 - DNA, 18 bp, Artificial Sequence
  source: /note="Description of Artificial Sequence: Synthetic oligonucleotide"
ctcctccggggtccaggc

SEQ ID NO: 1022 - DNA, 18 bp, Artificial Sequence
  source: /note="Description of Artificial Sequence: Synthetic oligonucleotide"
ggctcctccggggtccag

SEQ ID NO: 1023 - DNA, 18 bp, Artificial Sequence
  source: /note="Description of Artificial Sequence: Synthetic oligonucleotide"
ctggctcctccggggtcc

SEQ ID NO: 1024 - DNA, 18 bp, Artificial Sequence
  source: /note="Description of Artificial Sequence: Synthetic oligonucleotide"
agctggctcctccggggt

SEQ ID NO: 1025 - DNA, 18 bp, Artificial Sequence
  source: /note="Description of Artificial Sequence: Synthetic oligonucleotide"
gtagctggctcctccggg

SEQ ID NO: 1026 - DNA, 18 bp, Artificial Sequence
  source: /note="Description of Artificial Sequence: Synthetic oligonucleotide"
ctgtagctggctcctccg

SEQ ID NO: 1027 - DNA, 18 bp, Artificial Sequence
  source: /note="Description of Artificial Sequence: Synthetic oligonucleotide"
agctgtagctggctcctc

SEQ ID NO: 1028 - DNA, 18 bp, Artificial Sequence
  source: /note="Description of Artificial Sequence: Synthetic oligonucleotide"
gcagctgtagctggctcc

SEQ ID NO: 1029 - DNA, 18 bp, Artificial Sequence
  source: /note="Description of Artificial Sequence: Synthetic oligonucleotide"
cagcagctgtagctggct

SEQ ID NO: 1030 - DNA, 18 bp, Artificial Sequence
  source: /note="Description of Artificial Sequence: Synthetic oligonucleotide"
ggcagcagctgtagctgg

SEQ ID NO: 1031 - DNA, 18 bp, Artificial Sequence
  source: /note="Description of Artificial Sequence: Synthetic oligonucleotide"
acggcagcagctgtagct

SEQ ID NO: 1032 - DNA, 18 bp, Artificial Sequence
  source: /note="Description of Artificial Sequence: Synthetic oligonucleotide"
ggacggcagcagctgtag

SEQ ID NO: 1033 - DNA, 18 bp, Artificial Sequence
  source: /note="Description of Artificial Sequence: Synthetic oligonucleotide"
ggggacggcagcagctgt

SEQ ID NO: 1034 - DNA, 18 bp, Artificial Sequence
  source: /note="Description of Artificial Sequence: Synthetic oligonucleotide"
aaggggacggcagcagct

SEQ ID NO: 1035 - DNA, 18 bp, Artificial Sequence
  source: /note="Description of Artificial Sequence: Synthetic oligonucleotide"
agaaggggacggcagcag

SEQ ID NO: 1036 - DNA, 18 bp, Artificial Sequence
  source: /note="Description of Artificial Sequence: Synthetic oligonucleotide"
ccagaaggggacggcagc

SEQ ID NO: 1037 - DNA, 18 bp, Artificial Sequence
  source: /note="Description of Artificial Sequence: Synthetic oligonucleotide"
caccagaaggggacggca

SEQ ID NO: 1038 - DNA, 18 bp, Artificial Sequence
  source: /note="Description of Artificial Sequence: Synthetic oligonucleotide"
ctcaccagaaggggacgg

SEQ ID NO: 1039 - DNA, 18 bp, Artificial Sequence
  source: /note="Description of Artificial Sequence: Synthetic oligonucleotide"
cactcaccagaaggggac

SEQ ID NO: 1040 - DNA, 18 bp, Artificial Sequence
  source: /note="Description of Artificial Sequence: Synthetic oligonucleotide"
ggcactcaccagaagggg

SEQ ID NO: 1041 - DNA, 18 bp, Artificial Sequence
  source: /note="Description of Artificial Sequence: Synthetic oligonucleotide"
ggggcactcaccagaagg

SEQ ID NO: 1042 - DNA, 18 bp, Artificial Sequence
  source: /note="Description of Artificial Sequence: Synthetic oligonucleotide"
gaggggcactcaccagaa

SEQ ID NO: 1043 - DNA, 18 bp, Artificial Sequence
  source: /note="Description of Artificial Sequence: Synthetic oligonucleotide"
ctgaggggcactcaccag

SEQ ID NO: 1044 - DNA, 18 bp, Artificial Sequence
  source: /note="Description of Artificial Sequence: Synthetic oligonucleotide"
ggctgaggggcactcacc

SEQ ID NO: 1045 - DNA, 18 bp, Artificial Sequence
  source: /note="Description of Artificial Sequence: Synthetic oligonucleotide"
taggctgaggggcactca

SEQ ID NO: 1046 - DNA, 18 bp, Artificial Sequence
  source: /note="Description of Artificial Sequence: Synthetic oligonucleotide"
cctaggctgaggggcact

SEQ ID NO: 1047 - DNA, 18 bp, Artificial Sequence
  source: /note="Description of Artificial Sequence: Synthetic oligonucleotide"
tgcctaggctgaggggca

SEQ ID NO: 1048 - DNA, 18 bp, Artificial Sequence
  source: /note="Description of Artificial Sequence: Synthetic oligonucleotide"
cttgcctaggctgagggg

SEQ ID NO: 1049 - DNA, 18 bp, Artificial Sequence
  source: /note="Description of Artificial Sequence: Synthetic oligonucleotide"
ctcttgcctaggctgagg

SEQ ID NO: 1050 - DNA, 18 bp, Artificial Sequence
  source: /note="Description of Artificial Sequence: Synthetic oligonucleotide"
agctcttgcctaggctga

SEQ ID NO: 1051 - DNA, 18 bp, Artificial Sequence
  source: /note="Description of Artificial Sequence: Synthetic oligonucleotide"
ccagctcttgcctaggct

SEQ ID NO: 1052 - DNA, 18 bp, Artificial Sequence
  source: /note="Description of Artificial Sequence: Synthetic oligonucleotide"
tgccagctcttgcctagg

SEQ ID NO: 1053 - DNA, 18 bp, Artificial Sequence
  source: /note="Description of Artificial Sequence: Synthetic oligonucleotide"
gctgccagctcttgccta

SEQ ID NO: 1054 - DNA, 18 bp, Artificial Sequence
  source: /note="Description of Artificial Sequence: Synthetic oligonucleotide"
aggctgccagctcttgcc

SEQ ID NO: 1055 - DNA, 18 bp, Artificial Sequence
  source: /note="Description of Artificial Sequence: Synthetic oligonucleotide"
ccaggctgccagctcttg

SEQ ID NO: 1056 - DNA, 18 bp, Artificial Sequence
  source: /note="Description of Artificial Sequence: Synthetic oligonucleotide"
acccaggctgccagctct

SEQ ID NO: 1057 - DNA, 18 bp, Artificial Sequence
  source: /note="Description of Artificial Sequence: Synthetic oligonucleotide"
aaacccaggctgccagct

SEQ ID NO: 1058 - DNA, 18 bp, Artificial Sequence
  source: /note="Description of Artificial Sequence: Synthetic oligonucleotide"
gaaaacccaggctgccag

SEQ ID NO: 1059 - DNA, 18 bp, Artificial Sequence
  source: /note="Description of Artificial Sequence: Synthetic oligonucleotide"
gggaaaacccaggctgcc

SEQ ID NO: 1060 - DNA, 18 bp, Artificial Sequence
  source: /note="Description of Artificial Sequence: Synthetic oligonucleotide"
ttgggaaaacccaggctg

SEQ ID NO: 1061 - DNA, 18 bp, Artificial Sequence
  source: /note="Description of Artificial Sequence: Synthetic oligonucleotide"
ctttgggaaaacccaggc

SEQ ID NO: 1062 - DNA, 18 bp, Artificial Sequence
  source: /note="Description of Artificial Sequence: Synthetic oligonucleotide"
cttgtgcctggcgtcctc

SEQ ID NO: 1063 - DNA, 18 bp, Artificial Sequence
  source: /note="Description of Artificial Sequence: Synthetic oligonucleotide"
gacttgtgcctggcgtcc

SEQ ID NO: 1064 - DNA, 18 bp, Artificial Sequence
  source: /note="Description of Artificial Sequence: Synthetic oligonucleotide"
cagacttgtgcctggcgt

SEQ ID NO: 1065 - DNA, 18 bp, Artificial Sequence
  source: /note="Description of Artificial Sequence: Synthetic oligonucleotide"
cacagacttgtgcctggc

SEQ ID NO: 1066 - DNA, 18 bp, Artificial Sequence
  source: /note="Description of Artificial Sequence: Synthetic oligonucleotide"
accacagacttgtgcctg

SEQ ID NO: 1067 - DNA, 18 bp, Artificial Sequence
  source: /note="Description of Artificial Sequence: Synthetic oligonucleotide"
aaaccacagacttgtgcc

SEQ ID NO: 1068 - DNA, 18 bp, Artificial Sequence
  source: /note="Description of Artificial Sequence: Synthetic oligonucleotide"
ataaaccacagacttgtg

SEQ ID NO: 1069 - DNA, 18 bp, Artificial Sequence
  source: /note="Description of Artificial Sequence: Synthetic oligonucleotide"
tgataaaccacagacttg

SEQ ID NO: 1070 - DNA, 18 bp, Artificial Sequence
  source: /note="Description of Artificial Sequence: Synthetic oligonucleotide"
aatgataaaccacagact

SEQ ID NO: 1071 - DNA, 18 bp, Artificial Sequence
  source: /note="Description of Artificial Sequence: Synthetic oligonucleotide"
aaaatgataaaccacaga

SEQ ID NO: 1072 - DNA, 18 bp, Artificial Sequence
  source: /note="Description of Artificial Sequence: Synthetic oligonucleotide"
ggaaaatgataaaccaca

SEQ ID NO: 1073 - DNA, 18 bp, Artificial Sequence
  source: /note="Description of Artificial Sequence: Synthetic oligonucleotide"
agggaaaatgataaacca

SEQ ID NO: 1074 - DNA, 18 bp, Artificial Sequence
  source: /note="Description of Artificial Sequence: Synthetic oligonucleotide"
acagggaaaatgataaac

SEQ ID NO: 1075 - DNA, 18 bp, Artificial Sequence
  source: /note="Description of Artificial Sequence: Synthetic oligonucleotide"
agacagggaaaatgataa

SEQ ID NO: 1076 - DNA, 18 bp, Artificial Sequence
  source: /note="Description of Artificial Sequence: Synthetic oligonucleotide"
aaagacagggaaaatgat

SEQ ID NO: 1077 - DNA, 18 bp, Artificial Sequence
  source: /note="Description of Artificial Sequence: Synthetic oligonucleotide"
agaaagacagggaaaatg

SEQ ID NO: 1078 - DNA, 18 bp, Artificial Sequence
  source: /note="Description of Artificial Sequence: Synthetic oligonucleotide"
ctagaaagacagggaaaa

SEQ ID NO: 1079 - DNA, 18 bp, Artificial Sequence
  source: /note="Description of Artificial Sequence: Synthetic oligonucleotide"
tcctagaaagacagggaa

SEQ ID NO: 1080 - DNA, 18 bp, Artificial Sequence
  source: /note="Description of Artificial Sequence: Synthetic oligonucleotide"
tgtcctagaaagacaggg

SEQ ID NO: 1081 - DNA, 18 bp, Artificial Sequence
  source: /note="Description of Artificial Sequence: Synthetic oligonucleotide"
tttgtcctagaaagacag

SEQ ID NO: 1082 - DNA, 18 bp, Artificial Sequence
  source: /note="Description of Artificial Sequence: Synthetic oligonucleotide"
catttgtcctagaaagac

SEQ ID NO: 1083 - DNA, 18 bp, Artificial Sequence
  source: /note="Description of Artificial Sequence: Synthetic oligonucleotide"
gccatttgtcctagaaag

SEQ ID NO: 1084 - DNA, 18 bp, Artificial Sequence
  source: /note="Description of Artificial Sequence: Synthetic oligonucleotide"
gggccatttgtcctagaa

SEQ ID NO: 1085 - DNA, 18 bp, Artificial Sequence
  source: /note="Description of Artificial Sequence: Synthetic oligonucleotide"
gtgggccatttgtcctag

SEQ ID NO: 1086 - DNA, 18 bp, Artificial Sequence
  source: /note="Description of Artificial Sequence: Synthetic oligonucleotide"
ttgtgggccatttgtcct

SEQ ID NO: 1087 - DNA, 18 bp, Artificial Sequence
  source: /note="Description of Artificial Sequence: Synthetic oligonucleotide"
tgttgtgggccatttgtc

SEQ ID NO: 1088 - DNA, 18 bp, Artificial Sequence
  source: /note="Description of Artificial Sequence: Synthetic oligonucleotide"
agtgttgtgggccatttg

SEQ ID NO: 1089 - DNA, 18 bp, Artificial Sequence
  source: /note="Description of Artificial Sequence: Synthetic oligonucleotide"
tcagtgttgtgggccatt

SEQ ID NO: 1090 - DNA, 18 bp, Artificial Sequence
  source: /note="Description of Artificial Sequence: Synthetic oligonucleotide"
gctcagtgttgtgggcca

SEQ ID NO: 1091 - DNA, 18 bp, Artificial Sequence
  source: /note="Description of Artificial Sequence: Synthetic oligonucleotide"
ctgctcagtgttgtgggc

SEQ ID NO: 1092 - DNA, 18 bp, Artificial Sequence
  source: /note="Description of Artificial Sequence: Synthetic oligonucleotide"
gcctgctcagtgttgtgg

SEQ ID NO: 1093 - DNA, 18 bp, Artificial Sequence
  source: /note="Description of Artificial Sequence: Synthetic oligonucleotide"
atgcctgctcagtgttgt

SEQ ID NO: 1094 - DNA, 18 bp, Artificial Sequence
  source: /note="Description of Artificial Sequence: Synthetic oligonucleotide"
agatgcctgctcagtgtt

SEQ ID NO: 1095 - DNA, 18 bp, Artificial Sequence
  source: /note="Description of Artificial Sequence: Synthetic oligonucleotide"
ccagatgcctgctcagtg

SEQ ID NO: 1096 - DNA, 18 bp, Artificial Sequence
  source: /note="Description of Artificial Sequence: Synthetic oligonucleotide"
acccagatgcctgctcag

SEQ ID NO: 1097 - DNA, 18 bp, Artificial Sequence
  source: /note="Description of Artificial Sequence: Synthetic oligonucleotide"
ccacccagatgcctgctc

SEQ ID NO: 1098 - DNA, 18 bp, Artificial Sequence
  source: /note="Description of Artificial Sequence: Synthetic oligonucleotide"
ggccacccagatgcctgc

SEQ ID NO: 1099 - DNA, 18 bp, Artificial Sequence
  source: /note="Description of Artificial Sequence: Synthetic oligonucleotide"
ggggccacccagatgcct

SEQ ID NO: 1100 - DNA, 18 bp, Artificial Sequence
  source: /note="Description of Artificial Sequence: Synthetic oligonucleotide"
caggggccacccagatgc

SEQ ID NO: 1101 - DNA, 18 bp, Artificial Sequence
  source: /note="Description of Artificial Sequence: Synthetic oligonucleotide"
ggcaggggccacccagat

SEQ ID NO: 1102 - DNA, 18 bp, Artificial Sequence
  source: /note="Description of Artificial Sequence: Synthetic oligonucleotide"
ctggcaggggccacccag

SEQ ID NO: 1103 - DNA, 18 bp, Artificial Sequence
  source: /note="Description of Artificial Sequence: Synthetic oligonucleotide"
acctggcaggggccaccc

SEQ ID NO: 1104 - DNA, 18 bp, Artificial Sequence
  source: /note="Description of Artificial Sequence: Synthetic oligonucleotide"
caacctggcaggggccac

SEQ ID NO: 1105 - DNA, 18 bp, Artificial Sequence
  source: /note="Description of Artificial Sequence: Synthetic oligonucleotide"
atcaacctggcaggggcc

SEQ ID NO: 1106 - DNA, 18 bp, Artificial Sequence
  source: /note="Description of Artificial Sequence: Synthetic oligonucleotide"
gcatcaacctggcagggg

SEQ ID NO: 1107 - DNA, 18 bp, Artificial Sequence
  source: /note="Description of Artificial Sequence: Synthetic oligonucleotide"
gggcatcaacctggcagg

SEQ ID NO: 1108 - DNA, 18 bp, Artificial Sequence
  source: /note="Description of Artificial Sequence: Synthetic oligonucleotide"
gtgggcatcaacctggca

SEQ ID NO: 1109 - DNA, 18 bp, Artificial Sequence
  source: /note="Description of Artificial Sequence: Synthetic oligonucleotide"
cagtgggcatcaacctgg

SEQ ID NO: 1110 - DNA, 18 bp, Artificial Sequence
  source: /note="Description of Artificial Sequence: Synthetic oligonucleotide"
agcagtgggcatcaacct

SEQ ID NO: 1111 - DNA, 18 bp, Artificial Sequence
  source: /note="Description of Artificial Sequence: Synthetic oligonucleotide"
agagcagtgggcatcaac

SEQ ID NO: 1112 - DNA, 18 bp, Artificial Sequence
  source: /note="Description of Artificial Sequence: Synthetic oligonucleotide"
gcagagcagtgggcatca

SEQ ID NO: 1113 - DNA, 18 bp, Artificial Sequence
  source: /note="Description of Artificial Sequence: Synthetic oligonucleotide"
cggcagagcagtgggcat

SEQ ID NO: 1114 - DNA, 18 bp, Artificial Sequence
  source: /note="Description of Artificial Sequence: Synthetic oligonucleotide"
gccggcagagcagtgggc

SEQ ID NO: 1115 - DNA, 18 bp, Artificial Sequence
  source: /note="Description of Artificial Sequence: Synthetic oligonucleotide"
tggccggcagagcagtgg

SEQ ID NO: 1116 - DNA, 18 bp, Artificial Sequence
  source: /note="Description of Artificial Sequence: Synthetic oligonucleotide"
agtggccggcagagcagt

SEQ ID NO: 1117 - DNA, 18 bp, Artificial Sequence
  source: /note="Description of Artificial Sequence: Synthetic oligonucleotide"
ggagtggccggcagagca

SEQ ID NO: 1118 - DNA, 18 bp, Artificial Sequence
  source: /note="Description of Artificial Sequence: Synthetic oligonucleotide"
caggagtggccggcagag

SEQ ID NO: 1119 - DNA, 18 bp, Artificial Sequence
  source: /note="Description of Artificial Sequence: Synthetic oligonucleotide"
tgcaggagtggccggcag

SEQ ID NO: 1120 - DNA, 18 bp, Artificial Sequence
  source: /note="Description of Artificial Sequence: Synthetic oligonucleotide"
gatgcaggagtggccggc

SEQ ID NO: 1121 - DNA, 18 bp, Artificial Sequence
  source: /note="Description of Artificial Sequence: Synthetic oligonucleotide"
aagatgcaggagtggccg

SEQ ID NO: 1122 - DNA, 18 bp, Artificial Sequence
  source: /note="Description of Artificial Sequence: Synthetic oligonucleotide"
taaagatgcaggagtggc

SEQ ID NO: 1123 - DNA, 18 bp, Artificial Sequence
  source: /note="Description of Artificial Sequence: Synthetic oligonucleotide"
ggtaaagatgcaggagtg

SEQ ID NO: 1124 - DNA, 18 bp, Artificial Sequence
  source: /note="Description of Artificial Sequence: Synthetic oligonucleotide"
acggtaaagatgcaggag

SEQ ID NO: 1125 - DNA, 18 bp, Artificial Sequence
  source: /note="Description of Artificial Sequence: Synthetic oligonucleotide"
agacggtaaagatgcagg

SEQ ID NO: 1126 - DNA, 18 bp, Artificial Sequence
  source: /note="Description of Artificial Sequence: Synthetic oligonucleotide"
tgagacggtaaagatgca

SEQ ID NO: 1127 - DNA, 18 bp, Artificial Sequence
  source: /note="Description of Artificial Sequence: Synthetic oligonucleotide"
cctgagacggtaaagatg

SEQ ID NO: 1128 - DNA, 18 bp, Artificial Sequence
  source: /note="Description of Artificial Sequence: Synthetic oligonucleotide"
tccctgagacggtaaaga

SEQ ID NO: 1129 - DNA, 18 bp, Artificial Sequence
  source: /note="Description of Artificial Sequence: Synthetic oligonucleotide"
agtccctgagacggtaaa

SEQ ID NO: 1130 - DNA, 18 bp, Artificial Sequence
  source: /note="Description of Artificial Sequence: Synthetic oligonucleotide"
gaagtccctgagacggta

SEQ ID NO: 1131 - DNA, 18 bp, Artificial Sequence
  source: /note="Description of Artificial Sequence: Synthetic oligonucleotide"
tggaagtccctgagacgg

SEQ ID NO: 1132 - DNA, 18 bp, Artificial Sequence
  source: /note="Description of Artificial Sequence: Synthetic oligonucleotide"
actggaagtccctgagac

SEQ ID NO: 1133 - DNA, 18 bp, Artificial Sequence
  source: /note="Description of Artificial Sequence: Synthetic oligonucleotide"
caactggaagtccctgag

SEQ ID NO: 1134 - DNA, 18 bp, Artificial Sequence
  source: /note="Description of Artificial Sequence: Synthetic oligonucleotide"
agcaactggaagtccctg

SEQ ID NO: 1135 - DNA, 18 bp, Artificial Sequence
  source: /note="Description of Artificial Sequence: Synthetic oligonucleotide"
gcagcaactggaagtccc

SEQ ID NO: 1136 - DNA, 18 bp, Artificial Sequence
  source: /note="Description of Artificial Sequence: Synthetic oligonucleotide"
gggcagcaactggaagtc

SEQ ID NO: 1137 - DNA, 18 bp, Artificial Sequence
  source: /note="Description of Artificial Sequence: Synthetic oligonucleotide"
aggggcagcaactggaag

SEQ ID NO: 1138 - DNA, 18 bp, Artificial Sequence
  source: /note="Description of Artificial Sequence: Synthetic oligonucleotide"
gaaggggcagcaactgga

SEQ ID NO: 1139 - DNA, 18 bp, Artificial Sequence
  source: /note="Description of Artificial Sequence: Synthetic oligonucleotide"
gggaaggggcagcaactg

SEQ ID NO: 1140 - DNA, 18 bp, Artificial Sequence
  source: /note="Description of Artificial Sequence: Synthetic oligonucleotide"
ctgggaaggggcagcaac

SEQ ID NO: 1141 - DNA, 18 bp, Artificial Sequence
  source: /note="Description of Artificial Sequence: Synthetic oligonucleotide"
ctctgggaaggggcagca

SEQ ID NO: 1142 - DNA, 18 bp, Artificial Sequence
  source: /note="Description of Artificial Sequence: Synthetic oligonucleotide"
acctctgggaaggggcag

SEQ ID NO: 1143 - DNA, 18 bp, Artificial Sequence
  source: /note="Description of Artificial Sequence: Synthetic oligonucleotide"
tcacctctgggaaggggc

SEQ ID NO: 1144 - DNA, 18 bp, Artificial Sequence
  source: /note="Description of Artificial Sequence: Synthetic oligonucleotide"
gctcacctctgggaaggg

SEQ ID NO: 1145 - DNA, 18 bp, Artificial Sequence
  source: /note="Description of Artificial Sequence: Synthetic oligonucleotide"
acgctcacctctgggaag

SEQ ID NO: 1146 - DNA, 18 bp, Artificial Sequence
  source: /note="Description of Artificial Sequence: Synthetic oligonucleotide"
gcacgctcacctctggga

SEQ ID NO: 1147 - DNA, 18 bp, Artificial Sequence
  source: /note="Description of Artificial Sequence: Synthetic oligonucleotide"
tggcacgctcacctctgg

SEQ ID NO: 1148 - DNA, 18 bp, Artificial Sequence
  source: /note="Description of Artificial Sequence: Synthetic oligonucleotide"
gatggcacgctcacctct

SEQ ID NO: 1149 - DNA, 18 bp, Artificial Sequence
  source: /note="Description of Artificial Sequence: Synthetic oligonucleotide"
ctgatggcacgctcacct

SEQ ID NO: 1150 - DNA, 18 bp, Artificial Sequence
  source: /note="Description of Artificial Sequence: Synthetic oligonucleotide"
ggctgatggcacgctcac

SEQ ID NO: 1151 - DNA, 18 bp, Artificial Sequence
  source: /note="Description of Artificial Sequence: Synthetic oligonucleotide"
tgggctgatggcacgctc

SEQ ID NO: 1152 - DNA, 18 bp, Artificial Sequence
  source: /note="Description of Artificial Sequence: Synthetic oligonucleotide"
actgggctgatggcacgc

SEQ ID NO: 1153 - DNA, 18 bp, Artificial Sequence
  source: /note="Description of Artificial Sequence: Synthetic oligonucleotide"
ccactgggctgatggcac

SEQ ID NO: 1154 - DNA, 18 bp, Artificial Sequence
  source: /note="Description of Artificial Sequence: Synthetic oligonucleotide"
ctccactgggctgatggc

SEQ ID NO: 1155 - DNA, 18 bp, Artificial Sequence
  source: /note="Description of Artificial Sequence: Synthetic oligonucleotide"
ccctccactgggctgatg

SEQ ID NO: 1156 - DNA, 18 bp, Artificial Sequence
  source: /note="Description of Artificial Sequence: Synthetic oligonucleotide"
gcccctccactgggctga

SEQ ID NO: 1157 - DNA, 18 bp, Artificial Sequence
  source: /note="Description of Artificial Sequence: Synthetic oligonucleotide"
aagcccctccactgggct

SEQ ID NO: 1158 - DNA, 18 bp, Artificial Sequence
  source: /note="Description of Artificial Sequence: Synthetic oligonucleotide"
ctaagcccctccactggg

SEQ ID NO: 1159 - DNA, 18 bp, Artificial Sequence
  source: /note="Description of Artificial Sequence: Synthetic oligonucleotide"
acctaagcccctccactg

SEQ ID NO: 1160 - DNA, 18 bp, Artificial Sequence
  source: /note="Description of Artificial Sequence: Synthetic oligonucleotide"
agacctaagcccctccac

SEQ ID NO: 1161 - DNA, 18 bp, Artificial Sequence
  source: /note="Description of Artificial Sequence: Synthetic oligonucleotide"
gcagacctaagcccctcc

SEQ ID NO: 1162 - DNA, 18 bp, Artificial Sequence
  source: /note="Description of Artificial Sequence: Synthetic oligonucleotide"
atgcagacctaagcccct

SEQ ID NO: 1163 - DNA, 18 bp, Artificial Sequence
  source: /note="Description of Artificial Sequence: Synthetic oligonucleotide"
aaatgcagacctaagccc

SEQ ID NO: 1164 - DNA, 18 bp, Artificial Sequence
  source: /note="Description of Artificial Sequence: Synthetic oligonucleotide"
ataaatgcagacctaagc

SEQ ID NO: 1165 - DNA, 18 bp, Artificial Sequence
  source: /note="Description of Artificial Sequence: Synthetic oligonucleotide"
gcataaatgcagacctaa

SEQ ID NO: 1166 - DNA, 18 bp, Artificial Sequence
  source: /note="Description of Artificial Sequence: Synthetic oligonucleotide"
aagcataaatgcagacct

SEQ ID NO: 1167 - DNA, 18 bp, Artificial Sequence
  source: /note="Description of Artificial Sequence: Synthetic oligonucleotide"
cccttttatctgcaggtg

SEQ ID NO: 1168 - DNA, 18 bp, Artificial Sequence
  source: /note="Description of Artificial Sequence: Synthetic oligonucleotide"
ggcccttttatctgcagg

SEQ ID NO: 1169 - DNA, 18 bp, Artificial Sequence
  source: /note="Description of Artificial Sequence: Synthetic oligonucleotide"
agggcccttttatctgca

SEQ ID NO: 1170 - DNA, 18 bp, Artificial Sequence
  source: /note="Description of Artificial Sequence: Synthetic oligonucleotide"
gcagggcccttttatctg

SEQ ID NO: 1171 - DNA, 18 bp, Artificial Sequence
  source: /note="Description of Artificial Sequence: Synthetic oligonucleotide"
tggcagggcccttttatc

SEQ ID NO: 1172 - DNA, 18 bp, Artificial Sequence
  source: /note="Description of Artificial Sequence: Synthetic oligonucleotide"
attggcagggccctttta

SEQ ID NO: 1173 - DNA, 18 bp, Artificial Sequence
  source: /note="Description of Artificial Sequence: Synthetic oligonucleotide"
gcattggcagggcccttt

SEQ ID NO: 1174 - DNA, 18 bp, Artificial Sequence
  source: /note="Description of Artificial Sequence: Synthetic oligonucleotide"
ctgcattggcagggccct

SEQ ID NO: 1175 - DNA, 18 bp, Artificial Sequence
  source: /note="Description of Artificial Sequence: Synthetic oligonucleotide"
acctgcattggcagggcc

SEQ ID NO: 1176 - DNA, 18 bp, Artificial Sequence
  source: /note="Description of Artificial Sequence: Synthetic oligonucleotide"
aaacctgcattggcaggg

SEQ ID NO: 1177 - DNA, 18 bp, Artificial Sequence
  source: /note="Description of Artificial Sequence: Synthetic oligonucleotide"
agaaacctgcattggcag

SEQ ID NO: 1178 - DNA, 18 bp, Artificial Sequence
  source: /note="Description of Artificial Sequence: Synthetic oligonucleotide"
agagaaacctgcattggc

SEQ ID NO: 1179 - DNA, 18 bp, Artificial Sequence
  source: /note="Description of Artificial Sequence: Synthetic oligonucleotide"
acagagaaacctgcattg

SEQ ID NO: 1180 - DNA, 18 bp, Artificial Sequence
  source: /note="Description of Artificial Sequence: Synthetic oligonucleotide"
acacagagaaacctgcat

SEQ ID NO: 1181 - DNA, 18 bp, Artificial Sequence
  source: /note="Description of Artificial Sequence: Synthetic oligonucleotide"
gaacacagagaaacctgc

SEQ ID NO: 1182 - DNA, 18 bp, Artificial Sequence
  source: /note="Description of Artificial Sequence: Synthetic oligonucleotide"
tggaacacagagaaacct

SEQ ID NO: 1183 - DNA, 18 bp, Artificial Sequence
  source: /note="Description of Artificial Sequence: Synthetic oligonucleotide"
tgtggaacacagagaaac

SEQ ID NO: 1184 - DNA, 18 bp, Artificial Sequence
  source: /note="Description of Artificial Sequence: Synthetic oligonucleotide"
cctgtggaacacagagaa

SEQ ID NO: 1185 - DNA, 18 bp, Artificial Sequence
  source: /note="Description of Artificial Sequence: Synthetic oligonucleotide"
ggcctgtggaacacagag

SEQ ID NO: 1186 - DNA, 18 bp, Artificial Sequence
  source: /note="Description of Artificial Sequence: Synthetic oligonucleotide"
acggcctgtggaacacag

SEQ ID NO: 1187 - DNA, 18 bp, Artificial Sequence
  source: /note="Description of Artificial Sequence: Synthetic oligonucleotide"
ccacggcctgtggaacac

SEQ ID NO: 1188 - DNA, 18 bp, Artificial Sequence
  source: /note="Description of Artificial Sequence: Synthetic oligonucleotide"
tgccacggcctgtggaac

SEQ ID NO: 1189 - DNA, 18 bp, Artificial Sequence
  source: /note="Description of Artificial Sequence: Synthetic oligonucleotide"
catgccacggcctgtgga

SEQ ID NO: 1190 - DNA, 18 bp, Artificial Sequence
  source: /note="Description of Artificial Sequence: Synthetic oligonucleotide"
cgcatgccacggcctgtg

SEQ ID NO: 1191 - DNA, 18 bp, Artificial Sequence
  source: /note="Description of Artificial Sequence: Synthetic oligonucleotide"
cccgcatgccacggcctg

SEQ ID NO: 1192 - DNA, 18 bp, Artificial Sequence
  source: /note="Description of Artificial Sequence: Synthetic oligonucleotide"
tccccgcatgccacggcc

SEQ ID NO: 1193 - DNA, 18 bp, Artificial Sequence
  source: /note="Description of Artificial Sequence: Synthetic oligonucleotide"
catccccgcatgccacgg

SEQ ID NO: 1194 - DNA, 18 bp, Artificial Sequence
  source: /note="Description of Artificial Sequence: Synthetic oligonucleotide"
gccatccccgcatgccac

SEQ ID NO: 1195 - DNA, 18 bp, Artificial Sequence
  source: /note="Description of Artificial Sequence: Synthetic oligonucleotide"
tggccatccccgcatgcc

SEQ ID NO: 1196 - DNA, 18 bp, Artificial Sequence
  source: /note="Description of Artificial Sequence: Synthetic oligonucleotide"
gatggccatccccgcatg

SEQ ID NO: 1197 - DNA, 18 bp, Artificial Sequence
  source: /note="Description of Artificial Sequence: Synthetic oligonucleotide"
gtgatggccatccccgca

SEQ ID NO: 1198 - DNA, 18 bp, Artificial Sequence
  source: /note="Description of Artificial Sequence: Synthetic oligonucleotide"
cagtgatggccatccccg

SEQ ID NO: 1199 - DNA, 18 bp, Artificial Sequence
  source: /note="Description of Artificial Sequence: Synthetic oligonucleotide"
agcagtgatggccatccc

SEQ ID NO: 1200 - DNA, 18 bp, Artificial Sequence
  source: /note="Description of Artificial Sequence: Synthetic oligonucleotide"
gcagcagtgatggccatc

SEQ ID NO: 1201 - DNA, 18 bp, Artificial Sequence
  source: /note="Description of Artificial Sequence: Synthetic oligonucleotide"
gggcagcagtgatggcca

SEQ ID NO: 1202 - DNA, 18 bp, Artificial Sequence
  source: /note="Description of Artificial Sequence: Synthetic oligonucleotide"
gtgggcagcagtgatggc

SEQ ID NO: 1203 - DNA, 18 bp, Artificial Sequence
  source: /note="Description of Artificial Sequence: Synthetic oligonucleotide"
ccgtgggcagcagtgatg

SEQ ID NO: 1204 - DNA, 18 bp, Artificial Sequence
  source: /note="Description of Artificial Sequence: Synthetic oligonucleotide"
ccccgtgggcagcagtga

SEQ ID NO: 1205 - DNA, 18 bp, Artificial Sequence
  source: /note="Description of Artificial Sequence: Synthetic oligonucleotide"
agccccgtgggcagcagt

SEQ ID NO: 1206 - DNA, 18 bp, Artificial Sequence
  source: /note="Description of Artificial Sequence: Synthetic oligonucleotide"
gaagccccgtgggcagca

SEQ ID NO: 1207 - DNA, 18 bp, Artificial Sequence
  source: /note="Description of Artificial Sequence: Synthetic oligonucleotide"
tggaagccccgtgggcag

SEQ ID NO: 1208 - DNA, 18 bp, Artificial Sequence
  source: /note="Description of Artificial Sequence: Synthetic oligonucleotide"
agtggaagccccgtgggc

SEQ ID NO: 1209 - DNA, 18 bp, Artificial Sequence
  source: /note="Description of Artificial Sequence: Synthetic oligonucleotide"
gcagtggaagccccgtgg

SEQ ID NO: 1210 - DNA, 18 bp, Artificial Sequence
  source: /note="Description of Artificial Sequence: Synthetic oligonucleotide"
ctgcagtggaagccccgt

SEQ ID NO: 1211 - DNA, 18 bp, Artificial Sequence
  source: /note="Description of Artificial Sequence: Synthetic oligonucleotide"
cactgcagtggaagcccc

SEQ ID NO: 1212 - DNA, 18 bp, Artificial Sequence
  source: /note="Description of Artificial Sequence: Synthetic oligonucleotide"
tgcactgcagtggaagcc

SEQ ID NO: 1213 - DNA, 18 bp, Artificial Sequence
  source: /note="Description of Artificial Sequence: Synthetic oligonucleotide"
tctgcactgcagtggaag

SEQ ID NO: 1214 - DNA, 18 bp, Artificial Sequence
  source: /note="Description of Artificial Sequence: Synthetic oligonucleotide"
cgtctgcactgcagtgga

SEQ ID NO: 1215 - DNA, 18 bp, Artificial Sequence
  source: /note="Description of Artificial Sequence: Synthetic oligonucleotide"
cccgtctgcactgcagtg

SEQ ID NO: 1216 - DNA, 18 bp, Artificial Sequence
  source: /note="Description of Artificial Sequence: Synthetic oligonucleotide"
cgcccgtctgcactgcag

SEQ ID NO: 1217 - DNA, 18 bp, Artificial Sequence
  source: /note="Description of Artificial Sequence: Synthetic oligonucleotide"
atcgcccgtctgcactgc

SEQ ID NO: 1218 - DNA, 18 bp, Artificial Sequence
  source: /note="Description of Artificial Sequence: Synthetic oligonucleotide"
ggatcgcccgtctgcact

SEQ ID NO: 1219 - DNA, 18 bp, Artificial Sequence
  source: /note="Description of Artificial Sequence: Synthetic oligonucleotide"
caggatcgcccgtctgca

SEQ ID NO: 1220 - DNA, 18 bp, Artificial Sequence
  source: /note="Description of Artificial Sequence: Synthetic oligonucleotide"
agcaggatcgcccgtctg

SEQ ID NO: 1221 - DNA, 18 bp, Artificial Sequence
  source: /note="Description of Artificial Sequence: Synthetic oligonucleotide"
gaagcaggatcgcccgtc

SEQ ID NO: 1222 - DNA, 18 bp, Artificial Sequence
  source: /note="Description of Artificial Sequence: Synthetic oligonucleotide"
tggaagcaggatcgcccg

SEQ ID NO: 1223 - DNA, 18 bp, Artificial Sequence
  source: /note="Description of Artificial Sequence: Synthetic oligonucleotide"
tttggaagcaggatcgcc

SEQ ID NO: 1224 - DNA, 18 bp, Artificial Sequence
  source: /note="Description of Artificial Sequence: Synthetic oligonucleotide"
tctttggaagcaggatcg

SEQ ID NO: 1225 - DNA, 18 bp, Artificial Sequence
  source: /note="Description of Artificial Sequence: Synthetic oligonucleotide"
gatctttggaagcaggat

SEQ ID NO: 1226 - DNA, 18 bp, Artificial Sequence
  source: /note="Description of Artificial Sequence: Synthetic oligonucleotide"
ctgatctttggaagcagg

SEQ ID NO: 1227 - DNA, 18 bp, Artificial Sequence
  source: /note="Description of Artificial Sequence: Synthetic oligonucleotide"
acccacaccccagctgca

SEQ ID NO: 1228 - DNA, 18 bp, Artificial Sequence
  source: /note="Description of Artificial Sequence: Synthetic oligonucleotide"
gcacccacaccccagctg

SEQ ID NO: 1229 - DNA, 18 bp, Artificial Sequence
  source: /note="Description of Artificial Sequence: Synthetic oligonucleotide"
ctgcacccacaccccagc

SEQ ID NO: 1230 - DNA, 18 bp, Artificial Sequence
  source: /note="Description of Artificial Sequence: Synthetic oligonucleotide"
ccctgcacccacacccca

SEQ ID NO: 1231 - DNA, 18 bp, Artificial Sequence
  source: /note="Description of Artificial Sequence: Synthetic oligonucleotide"
tgccctgcacccacaccc

SEQ ID NO: 1232 - DNA, 18 bp, Artificial Sequence
  source: /note="Description of Artificial Sequence: Synthetic oligonucleotide"
cctgccctgcacccacac

SEQ ID NO: 1233 - DNA, 18 bp, Artificial Sequence
  source: /note="Description of Artificial Sequence: Synthetic oligonucleotide"
tgcctgccctgcacccac

SEQ ID NO: 1234 - DNA, 18 bp, Artificial Sequence
  source: /note="Description of Artificial Sequence: Synthetic oligonucleotide"
tctgcctgccctgcaccc

SEQ ID NO: 1235 - DNA, 18 bp, Artificial Sequence
  source: /note="Description of Artificial Sequence: Synthetic oligonucleotide"
cgtctgcctgccctgcac

SEQ ID NO: 1236 - DNA, 18 bp, Artificial Sequence
  source: /note="Description of Artificial Sequence: Synthetic oligonucleotide"
cccgtctgcctgccctgc

SEQ ID NO: 1237 - DNA, 18 bp, Artificial Sequence
  source: /note="Description of Artificial Sequence: Synthetic oligonucleotide"
tgcccgtctgcctgccct

SEQ ID NO: 1238 - DNA, 18 bp, Artificial Sequence
  source: /note="Description of Artificial Sequence: Synthetic oligonucleotide"
gctgcccgtctgcctgcc

SEQ ID NO: 1239 - DNA, 18 bp, Artificial Sequence
  source: /note="Description of Artificial Sequence: Synthetic oligonucleotide"
atgctgcccgtctgcctg

SEQ ID NO: 1240 - DNA, 18 bp, Artificial Sequence
  source: /note="Description of Artificial Sequence: Synthetic oligonucleotide"
ccacatgctgcccgtctg

SEQ ID NO: 1241 - DNA, 18 bp, Artificial Sequence
  source: /note="Description of Artificial Sequence: Synthetic oligonucleotide"
ctccacatgctgcccgtc

SEQ ID NO: 1242 - DNA, 18 bp, Artificial Sequence
  source: /note="Description of Artificial Sequence: Synthetic oligonucleotide"
gactccacatgctgcccg

SEQ ID NO: 1243 - DNA, 18 bp, Artificial Sequence
  source: /note="Description of Artificial Sequence: Synthetic oligonucleotide"
ccactcagggaaggtgac

SEQ ID NO: 1244 - DNA, 18 bp, Artificial Sequence
  source: /note="Description of Artificial Sequence: Synthetic oligonucleotide"
gcccactcagggaaggtg

SEQ ID NO: 1245 - DNA, 18 bp, Artificial Sequence
  source: /note="Description of Artificial Sequence: Synthetic oligonucleotide"
cagcccactcagggaagg

SEQ ID NO: 1246 - DNA, 18 bp, Artificial Sequence
  source: /note="Description of Artificial Sequence: Synthetic oligonucleotide"
accagcccactcagggaa

SEQ ID NO: 1247 - DNA, 18 bp, Artificial Sequence
  source: /note="Description of Artificial Sequence: Synthetic oligonucleotide"
ctaccagcccactcaggg

SEQ ID NO: 1248 - DNA, 18 bp, Artificial Sequence
  source: /note="Description of Artificial Sequence: Synthetic oligonucleotide"
tactaccagcccactcag

SEQ ID NO: 1249 - DNA, 18 bp, Artificial Sequence
  source: /note="Description of Artificial Sequence: Synthetic oligonucleotide"
gatactaccagcccactc

SEQ ID NO: 1250 - DNA, 18 bp, Artificial Sequence
  source: /note="Description of Artificial Sequence: Synthetic oligonucleotide"
aggatactaccagcccac

SEQ ID NO: 1251 - DNA, 18 bp, Artificial Sequence
  source: /note="Description of Artificial Sequence: Synthetic oligonucleotide"
ccaggatactaccagccc

SEQ ID NO: 1252 - DNA, 18 bp, Artificial Sequence
  source: /note="Description of Artificial Sequence: Synthetic oligonucleotide"
acccaggatactaccagc

SEQ ID NO: 1253 - DNA, 18 bp, Artificial Sequence
  source: /note="Description of Artificial Sequence: Synthetic oligonucleotide"
tgacccaggatactacca

SEQ ID NO: 1254 - DNA, 18 bp, Artificial Sequence
  source: /note="Description of Artificial Sequence: Synthetic oligonucleotide"
gatgacccaggatactac

SEQ ID NO: 1255 - DNA, 18 bp, Artificial Sequence
  source: /note="Description of Artificial Sequence: Synthetic oligonucleotide"
aagatgacccaggatact

SEQ ID NO: 1256 - DNA, 18 bp, Artificial Sequence
  source: /note="Description of Artificial Sequence: Synthetic oligonucleotide"
acaagatgacccaggata

SEQ ID NO: 1257 - DNA, 18 bp, Artificial Sequence
  source: /note="Description of Artificial Sequence: Synthetic oligonucleotide"
ggacaagatgacccagga

SEQ ID NO: 1258 - DNA, 18 bp, Artificial Sequence
  source: /note="Description of Artificial Sequence: Synthetic oligonucleotide"
gtggacaagatgacccag

SEQ ID NO: 1259 - DNA, 18 bp, Artificial Sequence
  source: /note="Description of Artificial Sequence: Synthetic oligonucleotide"
ctgtggacaagatgaccc

SEQ ID NO: 1260 - DNA, 18 bp, Artificial Sequence
  source: /note="Description of Artificial Sequence: Synthetic oligonucleotide"
acctgtggacaagatgac

SEQ ID NO: 1261 - DNA, 18 bp, Artificial Sequence
  source: /note="Description of Artificial Sequence: Synthetic oligonucleotide"
ttacctgtggacaagatg

SEQ ID NO: 1262 - DNA, 18 bp, Artificial Sequence
  source: /note="Description of Artificial Sequence: Synthetic oligonucleotide"
tgttacctgtggacaaga

SEQ ID NO: 1263 - DNA, 18 bp, Artificial Sequence
  source: /note="Description of Artificial Sequence: Synthetic oligonucleotide"
gttgttacctgtggacaa

SEQ ID NO: 1264 - DNA, 18 bp, Artificial Sequence
  source: /note="Description of Artificial Sequence: Synthetic oligonucleotide"
gagttgttacctgtggac

SEQ ID NO: 1265 - DNA, 18 bp, Artificial Sequence
  source: /note="Description of Artificial Sequence: Synthetic oligonucleotide"
cggagttgttacctgtgg

SEQ ID NO: 1266 - DNA, 18 bp, Artificial Sequence
  source: /note="Description of Artificial Sequence: Synthetic oligonucleotide"
cacggagttgttacctgt

SEQ ID NO: 1267 - DNA, 18 bp, Artificial Sequence
  source: /note="Description of Artificial Sequence: Synthetic oligonucleotide"
cccacggagttgttacct

SEQ ID NO: 1268 - DNA, 18 bp, Artificial Sequence
  source: /note="Description of Artificial Sequence: Synthetic oligonucleotide"
cacccacggagttgttac

SEQ ID NO: 1269 - DNA, 18 bp, Artificial Sequence
  source: /note="Description of Artificial Sequence: Synthetic oligonucleotide"
ggcacccacggagttgtt

SEQ ID NO: 1270 - DNA, 18 bp, Artificial Sequence
  source: /note="Description of Artificial Sequence: Synthetic oligonucleotide"
atggcacccacggagttg

SEQ ID NO: 1271 - DNA, 18 bp, Artificial Sequence
  source: /note="Description of Artificial Sequence: Synthetic oligonucleotide"
ggatggcacccacggagt

SEQ ID NO: 1272 - DNA, 18 bp, Artificial Sequence
  source: /note="Description of Artificial Sequence: Synthetic oligonucleotide"
ctggatggcacccacgga

SEQ ID NO: 1273 - DNA, 18 bp, Artificial Sequence
  source: /note="Description of Artificial Sequence: Synthetic oligonucleotide"
cactggatggcacccacg

SEQ ID NO: 1274 - DNA, 18 bp, Artificial Sequence
  source: /note="Description of Artificial Sequence: Synthetic oligonucleotide"
ggcactggatggcaccca

SEQ ID NO: 1275 - DNA, 18 bp, Artificial Sequence
  source: /note="Description of Artificial Sequence: Synthetic oligonucleotide"
agggcactggatggcacc

SEQ ID NO: 1276 - DNA, 18 bp, Artificial Sequence
  source: /note="Description of Artificial Sequence: Synthetic oligonucleotide"
tcagggcactggatggca

SEQ ID NO: 1277 - DNA, 18 bp, Artificial Sequence
  source: /note="Description of Artificial Sequence: Synthetic oligonucleotide"
tatcagggcactggatgg

SEQ ID NO: 1278 - DNA, 18 bp, Artificial Sequence
  source: /note="Description of Artificial Sequence: Synthetic oligonucleotide"
actatcagggcactggat

SEQ ID NO: 1279 - DNA, 18 bp, Artificial Sequence
  source: /note="Description of Artificial Sequence: Synthetic oligonucleotide"
tgactatcagggcactgg

SEQ ID NO: 1280 - DNA, 18 bp, Artificial Sequence
  source: /note="Description of Artificial Sequence: Synthetic oligonucleotide"
actgactatcagggcact

SEQ ID NO: 1281 - DNA, 18 bp, Artificial Sequence
  source: /note="Description of Artificial Sequence: Synthetic oligonucleotide"
gaactgactatcagggca

SEQ ID NO: 1282 - DNA, 18 bp, Artificial Sequence
  source: /note="Description of Artificial Sequence: Synthetic oligonucleotide"
tcgaactgactatcaggg

SEQ ID NO: 1283 - DNA, 18 bp, Artificial Sequence
  source: /note="Description of Artificial Sequence: Synthetic oligonucleotide"
attcgaactgactatcag

SEQ ID NO: 1284 - DNA, 18 bp, Artificial Sequence
  source: /note="Description of Artificial Sequence: Synthetic oligonucleotide"
gcattcgaactgactatc

SEQ ID NO: 1285 - DNA, 18 bp, Artificial Sequence
  source: /note="Description of Artificial Sequence: Synthetic oligonucleotide"
gggcattcgaactgacta

SEQ ID NO: 1286 - DNA, 18 bp, Artificial Sequence
  source: /note="Description of Artificial Sequence: Synthetic oligonucleotide"
ccgggcattcgaactgac

SEQ ID NO: 1287 - DNA, 18 bp, Artificial Sequence
  source: /note="Description of Artificial Sequence: Synthetic oligonucleotide"
gtccgggcattcgaactg

SEQ ID NO: 1288 - DNA, 18 bp, Artificial Sequence
  source: /note="Description of Artificial Sequence: Synthetic oligonucleotide"
aagtccgggcattcgaac

SEQ ID NO: 1289 - DNA, 18 bp, Artificial Sequence
  source: /note="Description of Artificial Sequence: Synthetic oligonucleotide"
agaagtccgggcattcga

SEQ ID NO: 1290 - DNA, 18 bp, Artificial Sequence
  source: /note="Description of Artificial Sequence: Synthetic oligonucleotide"
ggagaagtccgggcattc

SEQ ID NO: 1291 - DNA, 18 bp, Artificial Sequence
  source: /note="Description of Artificial Sequence: Synthetic oligonucleotide"
gtggagaagtccgggcat

SEQ ID NO: 1292 - DNA, 18 bp, Artificial Sequence
  source: /note="Description of Artificial Sequence: Synthetic oligonucleotide"
acgtggagaagtccgggc

SEQ ID NO: 1293 - DNA, 18 bp, Artificial Sequence
  source: /note="Description of Artificial Sequence: Synthetic oligonucleotide"
gcacgtggagaagtccgg

SEQ ID NO: 1294 - DNA, 18 bp, Artificial Sequence
  source: /note="Description of Artificial Sequence: Synthetic oligonucleotide"
cagcacgtggagaagtcc

SEQ ID NO: 1295 - DNA, 18 bp, Artificial Sequence
  source: /note="Description of Artificial Sequence: Synthetic oligonucleotide"
cacagcacgtggagaagt

SEQ ID NO: 1296 - DNA, 18 bp, Artificial Sequence
  source: /note="Description of Artificial Sequence: Synthetic oligonucleotide"
aacacagcacgtggagaa

SEQ ID NO: 1297 - DNA, 18 bp, Artificial Sequence
  source: /note="Description of Artificial Sequence: Synthetic oligonucleotide"
ataacacagcacgtggag

SEQ ID NO: 1298 - DNA, 18 bp, Artificial Sequence
  source: /note="Description of Artificial Sequence: Synthetic oligonucleotide"
ccataacacagcacgtgg

SEQ ID NO: 1299 - DNA, 18 bp, Artificial Sequence
  source: /note="Description of Artificial Sequence: Synthetic oligonucleotide"
gaccataacacagcacgt

SEQ ID NO: 1300 - DNA, 18 bp, Artificial Sequence
  source: /note="Description of Artificial Sequence: Synthetic oligonucleotide"
tcgaccataacacagcac

SEQ ID NO: 1301 - DNA, 18 bp, Artificial Sequence
  source: /note="Description of Artificial Sequence: Synthetic oligonucleotide"
catcgaccataacacagc

SEQ ID NO: 1302 - DNA, 18 bp, Artificial Sequence
  source: /note="Description of Artificial Sequence: Synthetic oligonucleotide"
gccatcgaccataacaca

SEQ ID NO: 1303 - DNA, 18 bp, Artificial Sequence
  source: /note="Description of Artificial Sequence: Synthetic oligonucleotide"
gagccatcgaccataaca

SEQ ID NO: 1304 - DNA, 18 bp, Artificial Sequence
  source: /note="Description of Artificial Sequence: Synthetic oligonucleotide"
aggagccatcgaccataa

SEQ ID NO: 1305 - DNA, 18 bp, Artificial Sequence
  source: /note="Description of Artificial Sequence: Synthetic oligonucleotide"
ccaggagccatcgaccat

SEQ ID NO: 1306 - DNA, 18 bp, Artificial Sequence
  source: /note="Description of Artificial Sequence: Synthetic oligonucleotide"
ccccaggagccatcgacc

SEQ ID NO: 1307 - DNA, 18 bp, Artificial Sequence
  source: /note="Description of Artificial Sequence: Synthetic oligonucleotide"
acccccaggagccatcga

SEQ ID NO: 1308 - DNA, 18 bp, Artificial Sequence
  source: /note="Description of Artificial Sequence: Synthetic oligonucleotide"
gcacccccaggagccatc

SEQ ID NO: 1309 - DNA, 18 bp, Artificial Sequence
  source: /note="Description of Artificial Sequence: Synthetic oligonucleotide"
cagcacccccaggagcca

SEQ ID NO: 1310 - DNA, 18 bp, Artificial Sequence
  source: /note="Description of Artificial Sequence: Synthetic oligonucleotide"
ggcagcacccccaggagc

SEQ ID NO: 1311 - DNA, 18 bp, Artificial Sequence
  source: /note="Description of Artificial Sequence: Synthetic oligonucleotide"
ggggcagcacccccagga

SEQ ID NO: 1312 - DNA, 18 bp, Artificial Sequence
  source: /note="Description of Artificial Sequence: Synthetic oligonucleotide"
atggggcagcacccccag

SEQ ID NO: 1313 - DNA, 18 bp, Artificial Sequence
  source: /note="Description of Artificial Sequence: Synthetic oligonucleotide"
gcatggggcagcaccccc

SEQ ID NO: 1314 - DNA, 18 bp, Artificial Sequence
  source: /note="Description of Artificial Sequence: Synthetic oligonucleotide"
gggcatggggcagcaccc

SEQ ID NO: 1315 - DNA, 18 bp, Artificial Sequence
  source: /note="Description of Artificial Sequence: Synthetic oligonucleotide"
tggggcatggggcagcac

SEQ ID NO: 1316 - DNA, 18 bp, Artificial Sequence
  source: /note="Description of Artificial Sequence: Synthetic oligonucleotide"
tctcccccagatttgtac

SEQ ID NO: 1317 - DNA, 18 bp, Artificial Sequence
  source: /note="Description of Artificial Sequence: Synthetic oligonucleotide"
catctcccccagatttgt

SEQ ID NO: 1318 - DNA, 18 bp, Artificial Sequence
  source: /note="Description of Artificial Sequence: Synthetic oligonucleotide"
cccatctcccccagattt

SEQ ID NO: 1319 - DNA, 18 bp, Artificial Sequence
  source: /note="Description of Artificial Sequence: Synthetic oligonucleotide"
cccccatctcccccagat

SEQ ID NO: 1320 - DNA, 18 bp, Artificial Sequence
  source: /note="Description of Artificial Sequence: Synthetic oligonucleotide"
tacccccatctcccccag

SEQ ID NO: 1321 - DNA, 18 bp, Artificial Sequence
  source: /note="Description of Artificial Sequence: Synthetic oligonucleotide"
catacccccatctccccc

SEQ ID NO: 1322 - DNA, 18 bp, Artificial Sequence
  source: /note="Description of Artificial Sequence: Synthetic oligonucleotide"
cacatacccccatctccc

SEQ ID NO: 1323 - DNA, 18 bp, Artificial Sequence
  source: /note="Description of Artificial Sequence: Synthetic oligonucleotide"
tccacatacccccatctc

SEQ ID NO: 1324 - DNA, 18 bp, Artificial Sequence
  source: /note="Description of Artificial Sequence: Synthetic oligonucleotide"
cctccacatacccccatc

SEQ ID NO: 1325 - DNA, 18 bp, Artificial Sequence
  source: /note="Description of Artificial Sequence: Synthetic oligonucleotide"
tccctccacataccccca

SEQ ID NO: 1326 - DNA, 18 bp, Artificial Sequence
  source: /note="Description of Artificial Sequence: Synthetic oligonucleotide"
cttccctccacatacccc

SEQ ID NO: 1327 - DNA, 18 bp, Artificial Sequence
  source: /note="Description of Artificial Sequence: Synthetic oligonucleotide"
cacttccctccacatacc

SEQ ID NO: 1328 - DNA, 18 bp, Artificial Sequence
  source: /note="Description of Artificial Sequence: Synthetic oligonucleotide"
cccacttccctccacata

SEQ ID NO: 1329 - DNA, 18 bp, Artificial Sequence
  source: /note="Description of Artificial Sequence: Synthetic oligonucleotide"
cccccacttccctccaca

SEQ ID NO: 1330 - DNA, 18 bp, Artificial Sequence
  source: /note="Description of Artificial Sequence: Synthetic oligonucleotide"
tgcccccacttccctcca

SEQ ID NO: 1331 - DNA, 18 bp, Artificial Sequence
  source: /note="Description of Artificial Sequence: Synthetic oligonucleotide"
tctgcccccacttccctc

SEQ ID NO: 1332 - DNA, 18 bp, Artificial Sequence
  source: /note="Description of Artificial Sequence: Synthetic oligonucleotide"
actctgcccccacttccc

SEQ ID NO: 1333 - DNA, 18 bp, Artificial Sequence
  source: /note="Description of Artificial Sequence: Synthetic oligonucleotide"
ccctgcccctggccccca

SEQ ID NO: 1334 - DNA, 18 bp, Artificial Sequence
  source: /note="Description of Artificial Sequence: Synthetic oligonucleotide"
ccccctgcccctggcccc

SEQ ID NO: 1335 - DNA, 18 bp, Artificial Sequence
  source: /note="Description of Artificial Sequence: Synthetic oligonucleotide"
caccccctgcccctggcc

SEQ ID NO: 1336 - DNA, 18 bp, Artificial Sequence
  source: /note="Description of Artificial Sequence: Synthetic oligonucleotide"
ttcaccccctgcccctgg

SEQ ID NO: 1337 - DNA, 18 bp, Artificial Sequence
  source: /note="Description of Artificial Sequence: Synthetic oligonucleotide"
tcttcaccccctgcccct

SEQ ID NO: 1338 - DNA, 18 bp, Artificial Sequence
  source: /note="Description of Artificial Sequence: Synthetic oligonucleotide"
cgtcttcaccccctgccc

SEQ ID NO: 1339 - DNA, 18 bp, Artificial Sequence
  source: /note="Description of Artificial Sequence: Synthetic oligonucleotide"
tccgtcttcaccccctgc

SEQ ID NO: 1340 - DNA, 18 bp, Artificial Sequence
  source: /note="Description of Artificial Sequence: Synthetic oligonucleotide"
actccgtcttcaccccct

SEQ ID NO: 1341 - DNA, 18 bp, Artificial Sequence
  source: /note="Description of Artificial Sequence: Synthetic oligonucleotide"
tgactccgtcttcacccc

SEQ ID NO: 1342 - DNA, 18 bp, Artificial Sequence
  source: /note="Description of Artificial Sequence: Synthetic oligonucleotide"
cctgactccgtcttcacc

SEQ ID NO: 1343 - DNA, 18 bp, Artificial Sequence
  source: /note="Description of Artificial Sequence: Synthetic oligonucleotide"
gtcctgactccgtcttca

SEQ ID NO: 1344 - DNA, 18 bp, Artificial Sequence
  source: /note="Description of Artificial Sequence: Synthetic oligonucleotide"
tggtcctgactccgtctt

SEQ ID NO: 1345 - DNA, 18 bp, Artificial Sequence
  source: /note="Description of Artificial Sequence: Synthetic oligonucleotide"
aatggtcctgactccgtc

SEQ ID NO: 1346 - DNA, 18 bp, Artificial Sequence
  source: /note="Description of Artificial Sequence: Synthetic oligonucleotide"
aaaatggtcctgactccg

SEQ ID NO: 1347 - DNA, 18 bp, Artificial Sequence
  source: /note="Description of Artificial Sequence: Synthetic oligonucleotide"
aaaaaatggtcctgactc

SEQ ID NO: 1348 - DNA, 18 bp, Artificial Sequence
  source: /note="Description of Artificial Sequence: Synthetic oligonucleotide"
agaaaaaatggtcctgac

SEQ ID NO: 1349 - DNA, 18 bp, Artificial Sequence
  source: /note="Description of Artificial Sequence: Synthetic oligonucleotide"
tgagaaaaaatggtcctg

SEQ ID NO: 1350 - DNA, 18 bp, Artificial Sequence
  source: /note="Description of Artificial Sequence: Synthetic oligonucleotide"
gtcttcacagcaggaagc

SEQ ID NO: 1351 - DNA, 18 bp, Artificial Sequence
  source: /note="Description of Artificial Sequence: Synthetic oligonucleotide"
ctgtcttcacagcaggaa

SEQ ID NO: 1352 - DNA, 18 bp, Artificial Sequence
  source: /note="Description of Artificial Sequence: Synthetic oligonucleotide"
ccctgtcttcacagcagg

SEQ ID NO: 1353 - DNA, 18 bp, Artificial Sequence
  source: /note="Description of Artificial Sequence: Synthetic oligonucleotide"
caccctgtcttcacagca

SEQ ID NO: 1354 - DNA, 18 bp, Artificial Sequence
  source: /note="Description of Artificial Sequence: Synthetic oligonucleotide"
tgcaccctgtcttcacag

SEQ ID NO: 1355 - DNA, 18 bp, Artificial Sequence
  source: /note="Description of Artificial Sequence: Synthetic oligonucleotide"
agtgcaccctgtcttcac

SEQ ID NO: 1356 - DNA, 18 bp, Artificial Sequence
  source: /note="Description of Artificial Sequence: Synthetic oligonucleotide"
gcagtgcaccctgtcttc

SEQ ID NO: 1357 - DNA, 18 bp, Artificial Sequence
  source: /note="Description of Artificial Sequence: Synthetic oligonucleotide"
cagcagtgcaccctgtct

SEQ ID NO: 1358 - DNA, 18 bp, Artificial Sequence
  source: /note="Description of Artificial Sequence: Synthetic oligonucleotide"
gacagcagtgcaccctgt

SEQ ID NO: 1359 - DNA, 18 bp, Artificial Sequence
  source: /note="Description of Artificial Sequence: Synthetic oligonucleotide"
cggacagcagtgcaccct

SEQ ID NO: 1360 - DNA, 18 bp, Artificial Sequence
  source: /note="Description of Artificial Sequence: Synthetic oligonucleotide"
tgcggacagcagtgcacc

SEQ ID NO: 1361 - DNA, 18 bp, Artificial Sequence
  source: /note="Description of Artificial Sequence: Synthetic oligonucleotide"
cgtgcggacagcagtgca

SEQ ID NO: 1362 - DNA, 18 bp, Artificial Sequence
  source: /note="Description of Artificial Sequence: Synthetic oligonucleotide"
accgtgcggacagcagtg

SEQ ID NO: 1363 - DNA, 18 bp, Artificial Sequence
  source: /note="Description of Artificial Sequence: Synthetic oligonucleotide"
gcaccgtgcggacagcag

SEQ ID NO: 1364 - DNA, 18 bp, Artificial Sequence
  source: /note="Description of Artificial Sequence: Synthetic oligonucleotide"
aggcaccgtgcggacagc

SEQ ID NO: 1365 - DNA, 18 bp, Artificial Sequence
  source: /note="Description of Artificial Sequence: Synthetic oligonucleotide"
gaaggcaccgtgcggaca

SEQ ID NO: 1366 - DNA, 18 bp, Artificial Sequence
  source: /note="Description of Artificial Sequence: Synthetic oligonucleotide"
cagaaggcaccgtgcgga

SEQ ID NO: 1367 - DNA, 18 bp, Artificial Sequence
  source: /note="Description of Artificial Sequence: Synthetic oligonucleotide"
cgcagaaggcaccgtgcg

SEQ ID NO: 1368 - DNA, 18 bp, Artificial Sequence
  source: /note="Description of Artificial Sequence: Synthetic oligonucleotide"
gtcgcagaaggcaccgtg

SEQ ID NO: 1369 - DNA, 18 bp, Artificial Sequence
  source: /note="Description of Artificial Sequence: Synthetic oligonucleotide"
aggtcgcagaaggcaccg

SEQ ID NO: 1370 - DNA, 18 bp, Artificial Sequence
  source: /note="Description of Artificial Sequence: Synthetic oligonucleotide"
ccaggtcgcagaaggcac

SEQ ID NO: 1371 - DNA, 18 bp, Artificial Sequence
  source: /note="Description of Artificial Sequence: Synthetic oligonucleotide"
aaccaggtcgcagaaggc

SEQ ID NO: 1372 - DNA, 18 bp, Artificial Sequence
  source: /note="Description of Artificial Sequence: Synthetic oligonucleotide"
tgaaccaggtcgcagaag

SEQ ID NO: 1373 - DNA, 18 bp, Artificial Sequence
  source: /note="Description of Artificial Sequence: Synthetic oligonucleotide"
tgtgaaccaggtcgcaga

SEQ ID NO: 1374 - DNA, 18 bp, Artificial Sequence
  source: /note="Description of Artificial Sequence: Synthetic oligonucleotide"
ggtgtgaaccaggtcgca

SEQ ID NO: 1375 - DNA, 18 bp, Artificial Sequence
  source: /note="Description of Artificial Sequence: Synthetic oligonucleotide"
cgggtgtgaaccaggtcg

SEQ ID NO: 1376 - DNA, 18 bp, Artificial Sequence
  source: /note="Description of Artificial Sequence: Synthetic oligonucleotide"
agcgggtgtgaaccaggt

SEQ ID NO: 1377 - DNA, 18 bp, Artificial Sequence
  source: /note="Description of Artificial Sequence: Synthetic oligonucleotide"
gcagcgggtgtgaaccag

SEQ ID NO: 1378 - DNA, 18 bp, Artificial Sequence
  source: /note="Description of Artificial Sequence: Synthetic oligonucleotide"
atgcagcgggtgtgaacc

SEQ ID NO: 1379 - DNA, 18 bp, Artificial Sequence
  source: /note="Description of Artificial Sequence: Synthetic oligonucleotide"
tgatgcagcgggtgtgaa

SEQ ID NO: 1380 - DNA, 18 bp, Artificial Sequence
  source: /note="Description of Artificial Sequence: Synthetic oligonucleotide"
tgtgatgcagcgggtgtg

SEQ ID NO: 1381 - DNA, 18 bp, Artificial Sequence
  source: /note="Description of Artificial Sequence: Synthetic oligonucleotide"
ggtgtgatgcagcgggtg

SEQ ID NO: 1382 - DNA, 18 bp, Artificial Sequence
  source: /note="Description of Artificial Sequence: Synthetic oligonucleotide"
tgggtgtgatgcagcggg

SEQ ID NO: 1383 - DNA, 18 bp, Artificial Sequence
  source: /note="Description of Artificial Sequence: Synthetic oligonucleotide"
cgtgggtgtgatgcagcg

SEQ ID NO: 1384 - DNA, 18 bp, Artificial Sequence
  source: /note="Description of Artificial Sequence: Synthetic oligonucleotide"
cccgtgggtgtgatgcag

SEQ ID NO: 1385 - DNA, 18 bp, Artificial Sequence
  source: /note="Description of Artificial Sequence: Synthetic oligonucleotide"
tgcccgtgggtgtgatgc

SEQ ID NO: 1386 - DNA, 18 bp, Artificial Sequence
  source: /note="Description of Artificial Sequence: Synthetic oligonucleotide"
ggtgcccgtgggtgtgat

SEQ ID NO: 1387 - DNA, 18 bp, Artificial Sequence
  source: /note="Description of Artificial Sequence: Synthetic oligonucleotide"
tgggtgcccgtgggtgtg

SEQ ID NO: 1388 - DNA, 18 bp, Artificial Sequence
  source: /note="Description of Artificial Sequence: Synthetic oligonucleotide"
ggtgggtgcccgtgggtg

SEQ ID NO: 1389 - DNA, 18 bp, Artificial Sequence
  source: /note="Description of Artificial Sequence: Synthetic oligonucleotide"
ggggtgggtgcccgtggg

SEQ ID NO: 1390 - DNA, 18 bp, Artificial Sequence
  source: /note="Description of Artificial Sequence: Synthetic oligonucleotide"
agggggtgggtgcccgtg

SEQ ID NO: 1391 - DNA, 18 bp, Artificial Sequence
  source: /note="Description of Artificial Sequence: Synthetic oligonucleotide"
ccagggggtgggtgcccg

SEQ ID NO: 1392 - DNA, 18 bp, Artificial Sequence
  source: /note="Description of Artificial Sequence: Synthetic oligonucleotide"
tgccagggggtgggtgcc

SEQ ID NO: 1393 - DNA, 18 bp, Artificial Sequence
  source: /note="Description of Artificial Sequence: Synthetic oligonucleotide"
tttgccagggggtgggtg

SEQ ID NO: 1394 - DNA, 18 bp, Artificial Sequence
  source: /note="Description of Artificial Sequence: Synthetic oligonucleotide"
tctttgccagggggtggg

SEQ ID NO: 1395 - DNA, 18 bp, Artificial Sequence
  source: /note="Description of Artificial Sequence: Synthetic oligonucleotide"
cttctttgccagggggtg

SEQ ID NO: 1396 - DNA, 18 bp, Artificial Sequence
  source: /note="Description of Artificial Sequence: Synthetic oligonucleotide"
agcttctttgccaggggg

SEQ ID NO: 1397 - DNA, 18 bp, Artificial Sequence
  source: /note="Description of Artificial Sequence: Synthetic oligonucleotide"
ggagcttctttgccaggg

SEQ ID NO: 1398 - DNA, 18 bp, Artificial Sequence
  source: /note="Description of Artificial Sequence: Synthetic oligonucleotide"
agggagcttctttgccag

SEQ ID NO: 1399 - DNA, 18 bp, Artificial Sequence
  source: /note="Description of Artificial Sequence: Synthetic oligonucleotide"
gcagggagcttctttgcc

SEQ ID NO: 1400 - DNA, 18 bp, Artificial Sequence
  source: /note="Description of Artificial Sequence: Synthetic oligonucleotide"
gggcagggagcttctttg

SEQ ID NO: 1401 - DNA, 18 bp, Artificial Sequence
  source: /note="Description of Artificial Sequence: Synthetic oligonucleotide"
ctgggcagggagcttctt

SEQ ID NO: 1402 - DNA, 18 bp, Artificial Sequence
  source: /note="Description of Artificial Sequence: Synthetic oligonucleotide"
ctctgggcagggagcttc

SEQ ID NO: 1403 - DNA, 18 bp, Artificial Sequence
  source: /note="Description of Artificial Sequence: Synthetic oligonucleotide"
tcctctgggcagggagct

SEQ ID NO: 1404 - DNA, 18 bp, Artificial Sequence
  source: /note="Description of Artificial Sequence: Synthetic oligonucleotide"
agtcctctgggcagggag

SEQ ID NO: 1405 - DNA, 18 bp, Artificial Sequence
  source: /note="Description of Artificial Sequence: Synthetic oligonucleotide"
ttagtcctctgggcaggg

SEQ ID NO: 1406 - DNA, 18 bp, Artificial Sequence
  source: /note="Description of Artificial Sequence: Synthetic oligonucleotide"
tgttagtcctctgggcag

SEQ ID NO: 1407 - DNA, 18 bp, Artificial Sequence
  source: /note="Description of Artificial Sequence: Synthetic oligonucleotide"
cctgttagtcctctgggc

SEQ ID NO: 1408 - DNA, 18 bp, Artificial Sequence
  source: /note="Description of Artificial Sequence: Synthetic oligonucleotide"
gccctgttagtcctctgg

SEQ ID NO: 1409 - DNA, 18 bp, Artificial Sequence
  source: /note="Description of Artificial Sequence: Synthetic oligonucleotide"
ctgccctgttagtcctct

SEQ ID NO: 1410 - DNA, 18 bp, Artificial Sequence
  source: /note="Description of Artificial Sequence: Synthetic oligonucleotide"
acctgccctgttagtcct

SEQ ID NO: 1411 - DNA, 18 bp, Artificial Sequence
  source: /note="Description of Artificial Sequence: Synthetic oligonucleotide"
tcacctgccctgttagtc

SEQ ID NO: 1412 - DNA, 18 bp, Artificial Sequence
  source: /note="Description of Artificial Sequence: Synthetic oligonucleotide"
cctcacctgccctgttag

SEQ ID NO: 1413 - DNA, 18 bp, Artificial Sequence
  source: /note="Description of Artificial Sequence: Synthetic oligonucleotide"
ctcctcacctgccctgtt

SEQ ID NO: 1414 - DNA, 18 bp, Artificial Sequence
  source: /note="Description of Artificial Sequence: Synthetic oligonucleotide"
acctcctcacctgccctg

SEQ ID NO: 1415 - DNA, 18 bp, Artificial Sequence
  source: /note="Description of Artificial Sequence: Synthetic oligonucleotide"
ccacctcctcacctgccc

SEQ ID NO: 1416 - DNA, 18 bp, Artificial Sequence
  source: /note="Description of Artificial Sequence: Synthetic oligonucleotide"
tcccacctcctcacctgc

SEQ ID NO: 1417 - DNA, 18 bp, Artificial Sequence
  source: /note="Description of Artificial Sequence: Synthetic oligonucleotide"
tctcccacctcctcacct

SEQ ID NO: 1418 - DNA, 18 bp, Artificial Sequence
  source: /note="Description of Artificial Sequence: Synthetic oligonucleotide"
gctctcccacctcctcac

SEQ ID NO: 1419 - DNA, 18 bp, Artificial Sequence
  source: /note="Description of Artificial Sequence: Synthetic oligonucleotide"
atgctctcccacctcctc

SEQ ID NO: 1420 - DNA, 18 bp, Artificial Sequence
  source: /note="Description of Artificial Sequence: Synthetic oligonucleotide"
tgatgctctcccacctcc

SEQ ID NO: 1421 - DNA, 18 bp, Artificial Sequence
  source: /note="Description of Artificial Sequence: Synthetic oligonucleotide"
cctgatgctctcccacct

SEQ ID NO: 1422 - DNA, 18 bp, Artificial Sequence
  source: /note="Description of Artificial Sequence: Synthetic oligonucleotide"
ggcctgatgctctcccac

SEQ ID NO: 1423 - DNA, 18 bp, Artificial Sequence
  source: /note="Description of Artificial Sequence: Synthetic oligonucleotide"
ctggcctgatgctctccc

SEQ ID NO: 1424 - DNA, 18 bp, Artificial Sequence
  source: /note="Description of Artificial Sequence: Synthetic oligonucleotide"
ccctggcctgatgctctc

SEQ ID NO: 1425 - DNA, 18 bp, Artificial Sequence
  source: /note="Description of Artificial Sequence: Synthetic oligonucleotide"
gcccctggcctgatgctc

SEQ ID NO: 1426 - DNA, 18 bp, Artificial Sequence
  source: /note="Description of Artificial Sequence: Synthetic oligonucleotide"
cagcccctggcctgatgc

SEQ ID NO: 1427 - DNA, 18 bp, Artificial Sequence
  source: /note="Description of Artificial Sequence: Synthetic oligonucleotide"
cccagcccctggcctgat

SEQ ID NO: 1428 - DNA, 18 bp, Artificial Sequence
  source: /note="Description of Artificial Sequence: Synthetic oligonucleotide"
gccccagcccctggcctg

SEQ ID NO: 1429 - DNA, 18 bp, Artificial Sequence
  source: /note="Description of Artificial Sequence: Synthetic oligonucleotide"
ccgccccagcccctggcc

SEQ ID NO: 1430 - DNA, 18 bp, Artificial Sequence
  source: /note="Description of Artificial Sequence: Synthetic oligonucleotide"
ccccgccccagcccctgg

SEQ ID NO: 1431 - DNA, 18 bp, Artificial Sequence
  source: /note="Description of Artificial Sequence: Synthetic oligonucleotide"
ggccccgccccagcccct

SEQ ID NO: 1432 - DNA, 18 bp, Artificial Sequence
  source: /note="Description of Artificial Sequence: Synthetic oligonucleotide"
gaggccccgccccagccc

SEQ ID NO: 1433 - DNA, 18 bp, Artificial Sequence
  source: /note="Description of Artificial Sequence: Synthetic oligonucleotide"
atgaggccccgccccagc

SEQ ID NO: 1434 - DNA, 18 bp, Artificial Sequence
  source: /note="Description of Artificial Sequence: Synthetic oligonucleotide"
caatgaggccccgcccca

SEQ ID NO: 1435 - DNA, 18 bp, Artificial Sequence
  source: /note="Description of Artificial Sequence: Synthetic oligonucleotide"
atggaggaaactttttcc

SEQ ID NO: 1436 - DNA, 18 bp, Artificial Sequence
  source: /note="Description of Artificial Sequence: Synthetic oligonucleotide"
ggatggaggaaacttttt

SEQ ID NO: 1437 - DNA, 18 bp, Artificial Sequence
  source: /note="Description of Artificial Sequence: Synthetic oligonucleotide"
caggatggaggaaacttt

SEQ ID NO: 1438 - DNA, 18 bp, Artificial Sequence
  source: /note="Description of Artificial Sequence: Synthetic oligonucleotide"
gccaggatggaggaaact

SEQ ID NO: 1439 - DNA, 18 bp, Artificial Sequence
  source: /note="Description of Artificial Sequence: Synthetic oligonucleotide"
cagccaggatggaggaaa

SEQ ID NO: 1440 - DNA, 18 bp, Artificial Sequence
  source: /note="Description of Artificial Sequence: Synthetic oligonucleotide"
ggcagccaggatggagga

SEQ ID NO: 1441 - DNA, 18 bp, Artificial Sequence
  source: /note="Description of Artificial Sequence: Synthetic oligonucleotide"
ggggcagccaggatggag

SEQ ID NO: 1442 - DNA, 18 bp, Artificial Sequence
  source: /note="Description of Artificial Sequence: Synthetic oligonucleotide"
gaggggcagccaggatgg

SEQ ID NO: 1443 - DNA, 18 bp, Artificial Sequence
  source: /note="Description of Artificial Sequence: Synthetic oligonucleotide"
gtgaggggcagccaggat

SEQ ID NO: 1444 - DNA, 18 bp, Artificial Sequence
  source: /note="Description of Artificial Sequence: Synthetic oligonucleotide"
acgtgaggggcagccagg

SEQ ID NO: 1445 - DNA, 18 bp, Artificial Sequence
  source: /note="Description of Artificial Sequence: Synthetic oligonucleotide"
aaacgtgaggggcagcca

SEQ ID NO: 1446 - DNA, 18 bp, Artificial Sequence
  source: /note="Description of Artificial Sequence: Synthetic oligonucleotide"
gcaaacgtgaggggcagc

SEQ ID NO: 1447 - DNA, 18 bp, Artificial Sequence
  source: /note="Description of Artificial Sequence: Synthetic oligonucleotide"
gagcaaacgtgaggggca

SEQ ID NO: 1448 - DNA, 18 bp, Artificial Sequence
  source: /note="Description of Artificial Sequence: Synthetic oligonucleotide"
aggagcaaacgtgagggg

SEQ ID NO: 1449 - DNA, 18 bp, Artificial Sequence
  source: /note="Description of Artificial Sequence: Synthetic oligonucleotide"
agaggagcaaacgtgagg

SEQ ID NO: 1450 - DNA, 18 bp, Artificial Sequence
  source: /note="Description of Artificial Sequence: Synthetic oligonucleotide"
gaagaggagcaaacgtga

SEQ ID NO: 1451 - DNA, 18 bp, Artificial Sequence
  source: /note="Description of Artificial Sequence: Synthetic oligonucleotide"
tggaagaggagcaaacgt

SEQ ID NO: 1452 - DNA, 18 bp, Artificial Sequence
  source: /note="Description of Artificial Sequence: Synthetic oligonucleotide"
ccgagctggacaaggcca

SEQ ID NO: 1453 - DNA, 18 bp, Artificial Sequence
  source: /note="Description of Artificial Sequence: Synthetic oligonucleotide"
gaccgagctggacaaggc

SEQ ID NO: 1454 - DNA, 18 bp, Artificial Sequence
  source: /note="Description of Artificial Sequence: Synthetic oligonucleotide"
atgaccgagctggacaag

SEQ ID NO: 1455 - DNA, 18 bp, Artificial Sequence
  source: /note="Description of Artificial Sequence: Synthetic oligonucleotide"
acatgaccgagctggaca

SEQ ID NO: 1456 - DNA, 18 bp, Artificial Sequence
  source: /note="Description of Artificial Sequence: Synthetic oligonucleotide"
acacatgaccgagctgga

SEQ ID NO: 1457 - DNA, 18 bp, Artificial Sequence
  source: /note="Description of Artificial Sequence: Synthetic oligonucleotide"
ggacacatgaccgagctg

SEQ ID NO: 1458 - DNA, 18 bp, Artificial Sequence
  source: /note="Description of Artificial Sequence: Synthetic oligonucleotide"
ccggacacatgaccgagc

SEQ ID NO: 1459 - DNA, 18 bp, Artificial Sequence
  source: /note="Description of Artificial Sequence: Synthetic oligonucleotide"
gtccggacacatgaccga

SEQ ID NO: 1460 - DNA, 18 bp, Artificial Sequence
  source: /note="Description of Artificial Sequence: Synthetic oligonucleotide"
gcgtccggacacatgacc

SEQ ID NO: 1461 - DNA, 18 bp, Artificial Sequence
  source: /note="Description of Artificial Sequence: Synthetic oligonucleotide"
gtgcgtccggacacatga

SEQ ID NO: 1462 - DNA, 18 bp, Artificial Sequence
  source: /note="Description of Artificial Sequence: Synthetic oligonucleotide"
ccgtgcgtccggacacat

SEQ ID NO: 1463 - DNA, 18 bp, Artificial Sequence
  source: /note="Description of Artificial Sequence: Synthetic oligonucleotide"
gaccgtgcgtccggacac

SEQ ID NO: 1464 - DNA, 18 bp, Artificial Sequence
  source: /note="Description of Artificial Sequence: Synthetic oligonucleotide"
gggaccgtgcgtccggac

SEQ ID NO: 1465 - DNA, 18 bp, Artificial Sequence
  source: /note="Description of Artificial Sequence: Synthetic oligonucleotide"
ccgggaccgtgcgtccgg

SEQ ID NO: 1466 - DNA, 18 bp, Artificial Sequence
  source: /note="Description of Artificial Sequence: Synthetic oligonucleotide"
caccgggaccgtgcgtcc

SEQ ID NO: 1467 - DNA, 18 bp, Artificial Sequence
  source: /note="Description of Artificial Sequence: Synthetic oligonucleotide"
ggcaccgggaccgtgcgt

SEQ ID NO: 1468 - DNA, 18 bp, Artificial Sequence
  source: /note="Description of Artificial Sequence: Synthetic oligonucleotide"
agggcaccgggaccgtgc

SEQ ID NO: 1469 - DNA, 18 bp, Artificial Sequence
  source: /note="Description of Artificial Sequence: Synthetic oligonucleotide"
tcagggcaccgggaccgt

SEQ ID NO: 1470 - DNA, 18 bp, Artificial Sequence
  source: /note="Description of Artificial Sequence: Synthetic oligonucleotide"
catcagggcaccgggacc

SEQ ID NO: 1471 - DNA, 18 bp, Artificial Sequence
  source: /note="Description of Artificial Sequence: Synthetic oligonucleotide"
accatcagggcaccggga

SEQ ID NO: 1472 - DNA, 18 bp, Artificial Sequence
  source: /note="Description of Artificial Sequence: Synthetic oligonucleotide"
gaaccatcagggcaccgg

SEQ ID NO: 1473 - DNA, 18 bp, Artificial Sequence
  source: /note="Description of Artificial Sequence: Synthetic oligonucleotide"
tagaaccatcagggcacc

SEQ ID NO: 1474 - DNA, 18 bp, Artificial Sequence
  source: /note="Description of Artificial Sequence: Synthetic oligonucleotide"
ggtagaaccatcagggca

SEQ ID NO: 1475 - DNA, 18 bp, Artificial Sequence
  source: /note="Description of Artificial Sequence: Synthetic oligonucleotide"
caggtagaaccatcaggg

SEQ ID NO: 1476 - DNA, 18 bp, Artificial Sequence
  source: /note="Description of Artificial Sequence: Synthetic oligonucleotide"
agcaggtagaaccatcag

SEQ ID NO: 1477 - DNA, 18 bp, Artificial Sequence
  source: /note="Description of Artificial Sequence: Synthetic oligonucleotide"
acagcaggtagaaccatc

SEQ ID NO: 1478 - DNA, 18 bp, Artificial Sequence
  source: /note="Description of Artificial Sequence: Synthetic oligonucleotide"
tcacagcaggtagaacca

SEQ ID NO: 1479 - DNA, 18 bp, Artificial Sequence
  source: /note="Description of Artificial Sequence: Synthetic oligonucleotide"
gctcacagcaggtagaac

SEQ ID NO: 1480 - DNA, 18 bp, Artificial Sequence
  source: /note="Description of Artificial Sequence: Synthetic oligonucleotide"
cagctcacagcaggtaga

SEQ ID NO: 1481 - DNA, 18 bp, Artificial Sequence
  source: /note="Description of Artificial Sequence: Synthetic oligonucleotide"
ggcagctcacagcaggta

SEQ ID NO: 1482 - DNA, 18 bp, Artificial Sequence
  source: /note="Description of Artificial Sequence: Synthetic oligonucleotide"
tgggcagctcacagcagg

SEQ ID NO: 1483 - DNA, 18 bp, Artificial Sequence
  source: /note="Description of Artificial Sequence: Synthetic oligonucleotide"
actgggcagctcacagca

SEQ ID NO: 1484 - DNA, 18 bp, Artificial Sequence
  source: /note="Description of Artificial Sequence: Synthetic oligonucleotide"
ccactgggcagctcacag

SEQ ID NO: 1485 - DNA, 18 bp, Artificial Sequence
  source: /note="Description of Artificial Sequence: Synthetic oligonucleotide"
tcccactgggcagctcac

SEQ ID NO: 1486 - DNA, 18 bp, Artificial Sequence
  source: /note="Description of Artificial Sequence: Synthetic oligonucleotide"
cttcccactgggcagctc

SEQ ID NO: 1487 - DNA, 18 bp, Artificial Sequence
  source: /note="Description of Artificial Sequence: Synthetic oligonucleotide"
tacttcccactgggcagc

SEQ ID NO: 1488 - DNA, 18 bp, Artificial Sequence
  source: /note="Description of Artificial Sequence: Synthetic oligonucleotide"
catacttcccactgggca

SEQ ID NO: 1489 - DNA, 18 bp, Artificial Sequence
  source: /note="Description of Artificial Sequence: Synthetic oligonucleotide"
gccatacttcccactggg

SEQ ID NO: 1490 - DNA, 18 bp, Artificial Sequence
  source: /note="Description of Artificial Sequence: Synthetic oligonucleotide"
cagccatacttcccactg

SEQ ID NO: 1491 - DNA, 18 bp, Artificial Sequence
  source: /note="Description of Artificial Sequence: Synthetic oligonucleotide"
agcagccatacttcccac

SEQ ID NO: 1492 - DNA, 18 bp, Artificial Sequence
  source: /note="Description of Artificial Sequence: Synthetic oligonucleotide"
gcagcagccatacttccc

SEQ ID NO: 1493 - DNA, 18 bp, Artificial Sequence
  source: /note="Description of Artificial Sequence: Synthetic oligonucleotide"
gggcagcagccatacttc

SEQ ID NO: 1494 - DNA, 18 bp, Artificial Sequence
  source: /note="Description of Artificial Sequence: Synthetic oligonucleotide"
ttgggcagcagccatact

SEQ ID NO: 1495 - DNA, 18 bp, Artificial Sequence
  source: /note="Description of Artificial Sequence: Synthetic oligonucleotide"
cattgggcagcagccata

SEQ ID NO: 1496 - DNA, 18 bp, Artificial Sequence
  source: /note="Description of Artificial Sequence: Synthetic oligonucleotide"
ggcattgggcagcagcca

SEQ ID NO: 1497 - DNA, 18 bp, Artificial Sequence
  source: /note="Description of Artificial Sequence: Synthetic oligonucleotide"
tgggcattgggcagcagc

SEQ ID NO: 1498 - DNA, 18 bp, Artificial Sequence
  source: /note="Description of Artificial Sequence: Synthetic oligonucleotide"
gttgggcattgggcagca

SEQ ID NO: 1499 - DNA, 18 bp, Artificial Sequence
  source: /note="Description of Artificial Sequence: Synthetic oligonucleotide"
gctccagcccctcactca

SEQ ID NO: 1500 - DNA, 18 bp, Artificial Sequence
  source: /note="Description of Artificial Sequence: Synthetic oligonucleotide"
tggctccagcccctcact

SEQ ID NO: 1501 - DNA, 18 bp, Artificial Sequence
  source: /note="Description of Artificial Sequence: Synthetic oligonucleotide"
gctggctccagcccctca

SEQ ID NO: 1502 - DNA, 18 bp, Artificial Sequence
  source: /note="Description of Artificial Sequence: Synthetic oligonucleotide"
aagctggctccagcccct

SEQ ID NO: 1503 - DNA, 18 bp, Artificial Sequence
  source: /note="Description of Artificial Sequence: Synthetic oligonucleotide"
ccaagctggctccagccc

SEQ ID NO: 1504 - DNA, 18 bp, Artificial Sequence
  source: /note="Description of Artificial Sequence: Synthetic oligonucleotide"
agccaagctggctccagc

SEQ ID NO: 1505 - DNA, 18 bp, Artificial Sequence
  source: /note="Description of Artificial Sequence: Synthetic oligonucleotide"
acagccaagctggctcca

SEQ ID NO: 1506 - DNA, 18 bp, Artificial Sequence
  source: /note="Description of Artificial Sequence: Synthetic oligonucleotide"
acacagccaagctggctc

SEQ ID NO: 1507 - DNA, 18 bp, Artificial Sequence
  source: /note="Description of Artificial Sequence: Synthetic oligonucleotide"
gcacacagccaagctggc

SEQ ID NO: 1508 - DNA, 18 bp, Artificial Sequence
  source: /note="Description of Artificial Sequence: Synthetic oligonucleotide"
gggcacacagccaagctg

SEQ ID NO: 1509 - DNA, 18 bp, Artificial Sequence
  source: /note="Description of Artificial Sequence: Synthetic oligonucleotide"
gggggcacacagccaagc

SEQ ID NO: 1510 - DNA, 18 bp, Artificial Sequence
  source: /note="Description of Artificial Sequence: Synthetic oligonucleotide"
ctgggggcacacagccaa

SEQ ID NO: 1511 - DNA, 18 bp, Artificial Sequence
  source: /note="Description of Artificial Sequence: Synthetic oligonucleotide"
ggctgggggcacacagcc

SEQ ID NO: 1512 - DNA, 18 bp, Artificial Sequence
  source: /note="Description of Artificial Sequence: Synthetic oligonucleotide"
gtggctgggggcacacag

SEQ ID NO: 1513 - DNA, 18 bp, Artificial Sequence
  source: /note="Description of Artificial Sequence: Synthetic oligonucleotide"
aggtggctgggggcacac

SEQ ID NO: 1514 - DNA, 18 bp, Artificial Sequence
  source: /note="Description of Artificial Sequence: Synthetic oligonucleotide"
ccaggtggctgggggcac

SEQ ID NO: 1515 - DNA, 18 bp, Artificial Sequence
  source: /note="Description of Artificial Sequence: Synthetic oligonucleotide"
ggccaggtggctgggggc

SEQ ID NO: 1516 - DNA, 18 bp, Artificial Sequence
  source: /note="Description of Artificial Sequence: Synthetic oligonucleotide"
ccagccccatgccacaga

SEQ ID NO: 1517 - DNA, 18 bp, Artificial Sequence
  source: /note="Description of Artificial Sequence: Synthetic oligonucleotide"
agccagccccatgccaca

SEQ ID NO: 1518 - DNA, 18 bp, Artificial Sequence
  source: /note="Description of Artificial Sequence: Synthetic oligonucleotide"
ccagccagccccatgcca

SEQ ID NO: 1519 - DNA, 18 bp, Artificial Sequence
  source: /note="Description of Artificial Sequence: Synthetic oligonucleotide"
cctgcatcagccaggctc

SEQ ID NO: 1520 - DNA, 18 bp, Artificial Sequence
  source: /note="Description of Artificial Sequence: Synthetic oligonucleotide"
accctgcatcagccaggc

SEQ ID NO: 1521 - DNA, 18 bp, Artificial Sequence
  source: /note="Description of Artificial Sequence: Synthetic oligonucleotide"
gaaccctgcatcagccag

SEQ ID NO: 1522 - DNA, 18 bp, Artificial Sequence
  source: /note="Description of Artificial Sequence: Synthetic oligonucleotide"
atgaaccctgcatcagcc

SEQ ID NO: 1523 - DNA, 18 bp, Artificial Sequence
  source: /note="Description of Artificial Sequence: Synthetic oligonucleotide"
tccaggctcagtagcaca

SEQ ID NO: 1524 - DNA, 18 bp, Artificial Sequence
  source: /note="Description of Artificial Sequence: Synthetic oligonucleotide"
cttccaggctcagtagca

SEQ ID NO: 1525 - DNA, 18 bp, Artificial Sequence
  source: /note="Description of Artificial Sequence: Synthetic oligonucleotide"
cacttccaggctcagtag

SEQ ID NO: 1526 - DNA, 18 bp, Artificial Sequence
  source: /note="Description of Artificial Sequence: Synthetic oligonucleotide"
gtcacttccaggctcagt

SEQ ID NO: 1527 - DNA, 18 bp, Artificial Sequence
  source: /note="Description of Artificial Sequence: Synthetic oligonucleotide"
ttgtcacttccaggctca

SEQ ID NO: 1528 - DNA, 18 bp, Artificial Sequence
  source: /note="Description of Artificial Sequence: Synthetic oligonucleotide"
ctttgtcacttccaggct

SEQ ID NO: 1529 - DNA, 18 bp, Artificial Sequence
  source: /note="Description of Artificial Sequence: Synthetic oligonucleotide"
gtctttgtcacttccagg

SEQ ID NO: 1530 - DNA, 18 bp, Artificial Sequence
  source: /note="Description of Artificial Sequence: Synthetic oligonucleotide"
gggtctttgtcacttcca

SEQ ID NO: 1531 - DNA, 18 bp, Artificial Sequence
  source: /note="Description of Artificial Sequence: Synthetic oligonucleotide"
gtgggtctttgtcacttc

SEQ ID NO: 1532 - DNA, 18 bp, Artificial Sequence
  source: /note="Description of Artificial Sequence: Synthetic oligonucleotide"
gggtgggtctttgtcact

SEQ ID NO: 1533 - DNA, 18 bp, Artificial Sequence
  source: /note="Description of Artificial Sequence: Synthetic oligonucleotide"
aggggtgggtctttgtca

SEQ ID NO: 1534 - DNA, 18 bp, Artificial Sequence
  source: /note="Description of Artificial Sequence: Synthetic oligonucleotide"
acaggggtgggtctttgt

SEQ ID NO: 1535 - DNA, 18 bp, Artificial Sequence
  source: /note="Description of Artificial Sequence: Synthetic oligonucleotide"
ggacaggggtgggtcttt

SEQ ID NO: 1536 - DNA, 18 bp, Artificial Sequence
  source: /note="Description of Artificial Sequence: Synthetic oligonucleotide"
ggggacaggggtgggtct

SEQ ID NO: 1537 - DNA, 18 bp, Artificial Sequence
  source: /note="Description of Artificial Sequence: Synthetic oligonucleotide"
gtggggacaggggtgggt

SEQ ID NO: 1538 - DNA, 18 bp, Artificial Sequence
  source: /note="Description of Artificial Sequence: Synthetic oligonucleotide"
gagtggggacaggggtgg

SEQ ID NO: 1539 - DNA, 18 bp, Artificial Sequence
  source: /note="Description of Artificial Sequence: Synthetic oligonucleotide"
ctgagtggggacaggggt

SEQ ID NO: 1540 - DNA, 18 bp, Artificial Sequence
  source: /note="Description of Artificial Sequence: Synthetic oligonucleotide"
gatcggagcagcaggtgg

SEQ ID NO: 1541 - DNA, 18 bp, Artificial Sequence
  source: /note="Description of Artificial Sequence: Synthetic oligonucleotide"
gtgatcggagcagcaggt

SEQ ID NO: 1542 - DNA, 18 bp, Artificial Sequence
  source: /note="Description of Artificial Sequence: Synthetic oligonucleotide"
aggtgatcggagcagcag

SEQ ID NO: 1543 - DNA, 18 bp, Artificial Sequence
  source: /note="Description of Artificial Sequence: Synthetic oligonucleotide"
gcaggtgatcggagcagc

SEQ ID NO: 1544 - DNA, 18 bp, Artificial Sequence
  source: /note="Description of Artificial Sequence: Synthetic oligonucleotide"
gtgcaggtgatcggagca

SEQ ID NO: 1545 - DNA, 18 bp, Artificial Sequence
  source: /note="Description of Artificial Sequence: Synthetic oligonucleotide"
cagtgcaggtgatcggag

SEQ ID NO: 1546 - DNA, 18 bp, Artificial Sequence
  source: /note="Description of Artificial Sequence: Synthetic oligonucleotide"
agcagtgcaggtgatcgg

SEQ ID NO: 1547 - DNA, 18 bp, Artificial Sequence
  source: /note="Description of Artificial Sequence: Synthetic oligonucleotide"
gcagcagtgcaggtgatc

SEQ ID NO: 1548 - DNA, 18 bp, Artificial Sequence
  source: /note="Description of Artificial Sequence: Synthetic oligonucleotide"
gggcagcagtgcaggtga

SEQ ID NO: 1549 - DNA, 18 bp, Artificial Sequence
  source: /note="Description of Artificial Sequence: Synthetic oligonucleotide"
gggggcagcagtgcaggt

SEQ ID NO: 1550 - DNA, 18 bp, Artificial Sequence
  source: /note="Description of Artificial Sequence: Synthetic oligonucleotide"
ttgggggcagcagtgcag

SEQ ID NO: 1551 - DNA, 18 bp, Artificial Sequence
  source: /note="Description of Artificial Sequence: Synthetic oligonucleotide"
tcttgggggcagcagtgc

SEQ ID NO: 1552 - DNA, 18 bp, Artificial Sequence
  source: /note="Description of Artificial Sequence: Synthetic oligonucleotide"
tgtcttgggggcagcagt

SEQ ID NO: 1553 - DNA, 18 bp, Artificial Sequence
  source: /note="Description of Artificial Sequence: Synthetic oligonucleotide"
agtgtcttgggggcagca

SEQ ID NO: 1554 - DNA, 18 bp, Artificial Sequence
  source: /note="Description of Artificial Sequence: Synthetic oligonucleotide"
acagtgtcttgggggcag

SEQ ID NO: 1555 - DNA, 18 bp, Artificial Sequence
  source: /note="Description of Artificial Sequence: Synthetic oligonucleotide"
acacagtgtcttgggggc

SEQ ID NO: 1556 - DNA, 18 bp, Artificial Sequence
  source: /note="Description of Artificial Sequence: Synthetic oligonucleotide"
acacacagtgtcttgggg

SEQ ID NO: 1557 - DNA, 18 bp, Artificial Sequence
  source: /note="Description of Artificial Sequence: Synthetic oligonucleotide"
tcacacacagtgtcttgg

SEQ ID NO: 1558 - DNA, 18 bp, Artificial Sequence
  source: /note="Description of Artificial Sequence: Synthetic oligonucleotide"
ggtcacacacagtgtctt

SEQ ID NO: 1559 - DNA, 18 bp, Artificial Sequence
  source: /note="Description of Artificial Sequence: Synthetic oligonucleotide"
caggtcacacacagtgtc

SEQ ID NO: 1560 - DNA, 18 bp, Artificial Sequence
  source: /note="Description of Artificial Sequence: Synthetic oligonucleotide"
atcaggtcacacacagtg

SEQ ID NO: 1561 - DNA, 18 bp, Artificial Sequence
  source: /note="Description of Artificial Sequence: Synthetic oligonucleotide"
ggatcaggtcacacacag

SEQ ID NO: 1562 - DNA, 18 bp, Artificial Sequence
  source: /note="Description of Artificial Sequence: Synthetic oligonucleotide"
ctggatcaggtcacacac

SEQ ID NO: 1563 - DNA, 18 bp, Artificial Sequence
  source: /note="Description of Artificial Sequence: Synthetic oligonucleotide"
ctctggatcaggtcacac

SEQ ID NO: 1564 - DNA, 18 bp, Artificial Sequence
  source: /note="Description of Artificial Sequence: Synthetic oligonucleotide"
tactctggatcaggtcac

SEQ ID NO: 1565 - DNA, 18 bp, Artificial Sequence
  source: /note="Description of Artificial Sequence: Synthetic oligonucleotide"
cttactctggatcaggtc

SEQ ID NO: 1566 - DNA, 18 bp, Artificial Sequence
  source: /note="Description of Artificial Sequence: Synthetic oligonucleotide"
cacttactctggatcagg

SEQ ID NO: 1567 - DNA, 18 bp, Artificial Sequence
  source: /note="Description of Artificial Sequence: Synthetic oligonucleotide"
ggcacttactctggatca

SEQ ID NO: 1568 - DNA, 18 bp, Artificial Sequence
  source: /note="Description of Artificial Sequence: Synthetic oligonucleotide"
gaggcacttactctggat

SEQ ID NO: 1569 - DNA, 18 bp, Artificial Sequence
  source: /note="Description of Artificial Sequence: Synthetic oligonucleotide"
gagaggcacttactctgg

SEQ ID NO: 1570 - DNA, 18 bp, Artificial Sequence
  source: /note="Description of Artificial Sequence: Synthetic oligonucleotide"
tggagaggcacttactct

SEQ ID NO: 1571 - DNA, 18 bp, Artificial Sequence
  source: /note="Description of Artificial Sequence: Synthetic oligonucleotide"
cttggagaggcacttact

SEQ ID NO: 1572 - DNA, 18 bp, Artificial Sequence
  source: /note="Description of Artificial Sequence: Synthetic oligonucleotide"
tccttggagaggcactta

SEQ ID NO: 1573 - DNA, 18 bp, Artificial Sequence
  source: /note="Description of Artificial Sequence: Synthetic oligonucleotide"
tctccttggagaggcact

SEQ ID NO: 1574 - DNA, 18 bp, Artificial Sequence
  source: /note="Description of Artificial Sequence: Synthetic oligonucleotide"
gttctccttggagaggca

SEQ ID NO: 1575 - DNA, 18 bp, Artificial Sequence
  source: /note="Description of Artificial Sequence: Synthetic oligonucleotide"
gcgttctccttggagagg

SEQ ID NO: 1576 - DNA, 18 bp, Artificial Sequence
  source: /note="Description of Artificial Sequence: Synthetic oligonucleotide"
tagcgttctccttggaga

SEQ ID NO: 1577 - DNA, 18 bp, Artificial Sequence
  source: /note="Description of Artificial Sequence: Synthetic oligonucleotide"
ggtagcgttctccttgga

SEQ ID NO: 1578 - DNA, 18 bp, Artificial Sequence
  source: /note="Description of Artificial Sequence: Synthetic oligonucleotide"
gtggtagcgttctccttg

SEQ ID NO: 1579 - DNA, 18 bp, Artificial Sequence
  source: /note="Description of Artificial Sequence: Synthetic oligonucleotide"
ccgtggtagcgttctcct

SEQ ID NO: 1580 - DNA, 18 bp, Artificial Sequence
  source: /note="Description of Artificial Sequence: Synthetic oligonucleotide"
gtccgtggtagcgttctc

SEQ ID NO: 1581 - DNA, 18 bp, Artificial Sequence
  source: /note="Description of Artificial Sequence: Synthetic oligonucleotide"
aggtccgtggtagcgttc

SEQ ID NO: 1582 - DNA, 18 bp, Artificial Sequence
  source: /note="Description of Artificial Sequence: Synthetic oligonucleotide"
ggaggtccgtggtagcgt

SEQ ID NO: 1583 - DNA, 18 bp, Artificial Sequence
  source: /note="Description of Artificial Sequence: Synthetic oligonucleotide"
gaggaggtccgtggtagc

SEQ ID NO: 1584 - DNA, 18 bp, Artificial Sequence
  source: /note="Description of Artificial Sequence: Synthetic oligonucleotide"
gtgaggaggtccgtggta

SEQ ID NO: 1585 - DNA, 18 bp, Artificial Sequence
  source: /note="Description of Artificial Sequence: Synthetic oligonucleotide"
tagtgaggaggtccgtgg

SEQ ID NO: 1586 - DNA, 18 bp, Artificial Sequence
  source: /note="Description of Artificial Sequence: Synthetic oligonucleotide"
cttagtgaggaggtccgt

SEQ ID NO: 1587 - DNA, 18 bp, Artificial Sequence
  source: /note="Description of Artificial Sequence: Synthetic oligonucleotide"
agcttagtgaggaggtcc

SEQ ID NO: 1588 - DNA, 18 bp, Artificial Sequence
  source: /note="Description of Artificial Sequence: Synthetic oligonucleotide"
gcagcttagtgaggaggt

SEQ ID NO: 1589 - DNA, 18 bp, Artificial Sequence
  source: /note="Description of Artificial Sequence: Synthetic oligonucleotide"
aggcagcttagtgaggag

SEQ ID NO: 1590 - DNA, 18 bp, Artificial Sequence
  source: /note="Description of Artificial Sequence: Synthetic oligonucleotide"
gcaggcagcttagtgagg

SEQ ID NO: 1591 - DNA, 18 bp, Artificial Sequence
  source: /note="Description of Artificial Sequence: Synthetic oligonucleotide"
gcgcaggcagcttagtga

SEQ ID NO: 1592 - DNA, 18 bp, Artificial Sequence
  source: /note="Description of Artificial Sequence: Synthetic oligonucleotide"
gtgcgcaggcagcttagt

SEQ ID NO: 1593 - DNA, 18 bp, Artificial Sequence
  source: /note="Description of Artificial Sequence: Synthetic oligonucleotide"
gtgtgcgcaggcagctta

SEQ ID NO: 1594 - DNA, 18 bp, Artificial Sequence
  source: /note="Description of Artificial Sequence: Synthetic oligonucleotide"
ctgtgtgcgcaggcagct

SEQ ID NO: 1595 - DNA, 18 bp, Artificial Sequence
  source: /note="Description of Artificial Sequence: Synthetic oligonucleotide"
tgcaccctgcctctggta

SEQ ID NO: 1596 - DNA, 18 bp, Artificial Sequence
  source: /note="Description of Artificial Sequence: Synthetic oligonucleotide"
tctgcaccctgcctctgg

SEQ ID NO: 1597 - DNA, 18 bp, Artificial Sequence
  source: /note="Description of Artificial Sequence: Synthetic oligonucleotide"
tatctgcaccctgcctct

SEQ ID NO: 1598 - DNA, 18 bp, Artificial Sequence
  source: /note="Description of Artificial Sequence: Synthetic oligonucleotide"
tgtatctgcaccctgcct

SEQ ID NO: 1599 - DNA, 18 bp, Artificial Sequence
  source: /note="Description of Artificial Sequence: Synthetic oligonucleotide"
cctgtatctgcaccctgc

SEQ ID NO: 1600 - DNA, 18 bp, Artificial Sequence
  source: /note="Description of Artificial Sequence: Synthetic oligonucleotide"
cccctgtatctgcaccct

SEQ ID NO: 1601 - DNA, 18 bp, Artificial Sequence
  source: /note="Description of Artificial Sequence: Synthetic oligonucleotide"
cacccctgtatctgcacc

SEQ ID NO: 1602 - DNA, 18 bp, Artificial Sequence
  source: /note="Description of Artificial Sequence: Synthetic oligonucleotide"
cccacccctgtatctgca

SEQ ID NO: 1603 - DNA, 18 bp, Artificial Sequence
  source: /note="Description of Artificial Sequence: Synthetic oligonucleotide"
gccccacccctgtatctg

SEQ ID NO: 1604 - DNA, 18 bp, Artificial Sequence
  source: /note="Description of Artificial Sequence: Synthetic oligonucleotide"
gggccccacccctgtatc

SEQ ID NO: 1605 - DNA, 18 bp, Artificial Sequence
  source: /note="Description of Artificial Sequence: Synthetic oligonucleotide"
gggggccccacccctgta

SEQ ID NO: 1606 - DNA, 18 bp, Artificial Sequence
  source: /note="Description of Artificial Sequence: Synthetic oligonucleotide"
aagggggccccacccctg

SEQ ID NO: 1607 - DNA, 18 bp, Artificial Sequence
  source: /note="Description of Artificial Sequence: Synthetic oligonucleotide"
gaaagggggccccacccc

SEQ ID NO: 1608 - DNA, 18 bp, Artificial Sequence
  source: /note="Description of Artificial Sequence: Synthetic oligonucleotide"
aggaaagggggccccacc

SEQ ID NO: 1609 - DNA, 18 bp, Artificial Sequence
  source: /note="Description of Artificial Sequence: Synthetic oligonucleotide"
ggaggaaagggggcccca

SEQ ID NO: 1610 - DNA, 18 bp, Artificial Sequence
  source: /note="Description of Artificial Sequence: Synthetic oligonucleotide"
agggaggaaagggggccc

SEQ ID NO: 1611 - DNA, 18 bp, Artificial Sequence
  source: /note="Description of Artificial Sequence: Synthetic oligonucleotide"
aaagggaggaaagggggc

SEQ ID NO: 1612 - DNA, 18 bp, Artificial Sequence
  source: /note="Description of Artificial Sequence: Synthetic oligonucleotide"
taaaagggaggaaagggg

SEQ ID NO: 1613 - DNA, 18 bp, Artificial Sequence
  source: /note="Description of Artificial Sequence: Synthetic oligonucleotide"
cctaaaagggaggaaagg

SEQ ID NO: 1614 - DNA, 18 bp, Artificial Sequence
  source: /note="Description of Artificial Sequence: Synthetic oligonucleotide"
ggcctaaaagggaggaaa

SEQ ID NO: 1615 - DNA, 18 bp, Artificial Sequence
  source: /note="Description of Artificial Sequence: Synthetic oligonucleotide"
caggcctaaaagggagga

SEQ ID NO: 1616 - DNA, 18 bp, Artificial Sequence
  source: /note="Description of Artificial Sequence: Synthetic oligonucleotide"
gccaggcctaaaagggag

SEQ ID NO: 1617 - DNA, 18 bp, Artificial Sequence
  source: /note="Description of Artificial Sequence: Synthetic oligonucleotide"
aggccaggcctaaaaggg

SEQ ID NO: 1618 - DNA, 18 bp, Artificial Sequence
  source: /note="Description of Artificial Sequence: Synthetic oligonucleotide"
taaggccaggcctaaaag

SEQ ID NO: 1619 - DNA, 18 bp, Artificial Sequence
  source: /note="Description of Artificial Sequence: Synthetic oligonucleotide"
cctaaggccaggcctaaa

SEQ ID NO: 1620 - DNA, 18 bp, Artificial Sequence
  source: /note="Description of Artificial Sequence: Synthetic oligonucleotide"
atcctaaggccaggccta

SEQ ID NO: 1621 - DNA, 18 bp, Artificial Sequence
  source: /note="Description of Artificial Sequence: Synthetic oligonucleotide"
tgatcctaaggccaggcc

SEQ ID NO: 1622 - DNA, 18 bp, Artificial Sequence
  source: /note="Description of Artificial Sequence: Synthetic oligonucleotide"
agtgatcctaaggccagg

SEQ ID NO: 1623 - DNA, 18 bp, Artificial Sequence
  source: /note="Description of Artificial Sequence: Synthetic oligonucleotide"
gcagtgatcctaaggcca

SEQ ID NO: 1624 - DNA, 18 bp, Artificial Sequence
  source: /note="Description of Artificial Sequence: Synthetic oligonucleotide"
ttgcagtgatcctaaggc

SEQ ID NO: 1625 - DNA, 18 bp, Artificial Sequence
  source: /note="Description of Artificial Sequence: Synthetic oligonucleotide"
ccttgcagtgatcctaag

SEQ ID NO: 1626 - DNA, 18 bp, Artificial Sequence
  source: /note="Description of Artificial Sequence: Synthetic oligonucleotide"
caccttgcagtgatccta

SEQ ID NO: 1627 - DNA, 18 bp, Artificial Sequence
  source: /note="Description of Artificial Sequence: Synthetic oligonucleotide"
accaccttgcagtgatcc

SEQ ID NO: 1628 - DNA, 18 bp, Artificial Sequence
  source: /note="Description of Artificial Sequence: Synthetic oligonucleotide"
acaccaccttgcagtgat

SEQ ID NO: 1629 - DNA, 18 bp, Artificial Sequence
  source: /note="Description of Artificial Sequence: Synthetic oligonucleotide"
ggcactggggaccctcag

SEQ ID NO: 1630 - DNA, 18 bp, Artificial Sequence
  source: /note="Description of Artificial Sequence: Synthetic oligonucleotide"
gtggcactggggaccctc

SEQ ID NO: 1631 - DNA, 18 bp, Artificial Sequence
  source: /note="Description of Artificial Sequence: Synthetic oligonucleotide"
aagtggcactggggaccc

SEQ ID NO: 1632 - DNA, 18 bp, Artificial Sequence
  source: /note="Description of Artificial Sequence: Synthetic oligonucleotide"
agaagtggcactggggac

SEQ ID NO: 1633 - DNA, 18 bp, Artificial Sequence
  source: /note="Description of Artificial Sequence: Synthetic oligonucleotide"
tcagaagtggcactgggg

SEQ ID NO: 1634 - DNA, 18 bp, Artificial Sequence
  source: /note="Description of Artificial Sequence: Synthetic oligonucleotide"
ggtcagaagtggcactgg

SEQ ID NO: 1635 - DNA, 18 bp, Artificial Sequence
  source: /note="Description of Artificial Sequence: Synthetic oligonucleotide"
caggtcagaagtggcact

SEQ ID NO: 1636 - DNA, 18 bp, Artificial Sequence
  source: /note="Description of Artificial Sequence: Synthetic oligonucleotide"
gacaggtcagaagtggca

SEQ ID NO: 1637 - DNA, 18 bp, Artificial Sequence
  source: /note="Description of Artificial Sequence: Synthetic oligonucleotide"
aggacaggtcagaagtgg

SEQ ID NO: 1638 - DNA, 18 bp, Artificial Sequence
  source: /note="Description of Artificial Sequence: Synthetic oligonucleotide"
agaggacaggtcagaagt

SEQ ID NO: 1639 - DNA, 18 bp, Artificial Sequence
  source: /note="Description of Artificial Sequence: Synthetic oligonucleotide"
agagaggacaggtcagaa

SEQ ID NO: 1640 - DNA, 18 bp, Artificial Sequence
  source: /note="Description of Artificial Sequence: Synthetic oligonucleotide"
gcagagaggacaggtcag

SEQ ID NO: 1641 - DNA, 18 bp, Artificial Sequence
  source: /note="Description of Artificial Sequence: Synthetic oligonucleotide"
aagcagagaggacaggtc

SEQ ID NO: 1642 - DNA, 18 bp, Artificial Sequence
  source: /note="Description of Artificial Sequence: Synthetic oligonucleotide"
ggaagcagagaggacagg

SEQ ID NO: 1643 - DNA, 18 bp, Artificial Sequence
  source: /note="Description of Artificial Sequence: Synthetic oligonucleotide"
agggaagcagagaggaca

SEQ ID NO: 1644 - DNA, 18 bp, Artificial Sequence
  source: /note="Description of Artificial Sequence: Synthetic oligonucleotide"
tgagggaagcagagagga

SEQ ID NO: 1645 - DNA, 18 bp, Artificial Sequence
  source: /note="Description of Artificial Sequence: Synthetic oligonucleotide"
tgtgagggaagcagagag

SEQ ID NO: 1646 - DNA, 18 bp, Artificial Sequence
  source: /note="Description of Artificial Sequence: Synthetic oligonucleotide"
cacatttcacatccccca

SEQ ID NO: 1647 - DNA, 18 bp, Artificial Sequence
  source: /note="Description of Artificial Sequence: Synthetic oligonucleotide"
gtcacatttcacatcccc

SEQ ID NO: 1648 - DNA, 18 bp, Artificial Sequence
  source: /note="Description of Artificial Sequence: Synthetic oligonucleotide"
atgtcacatttcacatcc

SEQ ID NO: 1649 - DNA, 18 bp, Artificial Sequence
  source: /note="Description of Artificial Sequence: Synthetic oligonucleotide"
ccatgtcacatttcacat

SEQ ID NO: 1650 - DNA, 18 bp, Artificial Sequence
  source: /note="Description of Artificial Sequence: Synthetic oligonucleotide"
ctccatgtcacatttcac

SEQ ID NO: 1651 - DNA, 18 bp, Artificial Sequence
  source: /note="Description of Artificial Sequence: Synthetic oligonucleotide"
acctccatgtcacatttc

SEQ ID NO: 1652 - DNA, 18 bp, Artificial Sequence
  source: /note="Description of Artificial Sequence: Synthetic oligonucleotide"
tcacctccatgtcacatt

SEQ ID NO: 1653 - DNA, 18 bp, Artificial Sequence
  source: /note="Description of Artificial Sequence: Synthetic oligonucleotide"
gctcacctccatgtcaca

SEQ ID NO: 1654 - DNA, 18 bp, Artificial Sequence
  source: /note="Description of Artificial Sequence: Synthetic oligonucleotide"
cagctcacctccatgtca

SEQ ID NO: 1655 - DNA, 18 bp, Artificial Sequence
  source: /note="Description of Artificial Sequence: Synthetic oligonucleotide"
ggcagctcacctccatgt

SEQ ID NO: 1656 - DNA, 18 bp, Artificial Sequence
  source: /note="Description of Artificial Sequence: Synthetic oligonucleotide"
tgggcagctcacctccat

SEQ ID NO: 1657 - DNA, 18 bp, Artificial Sequence
  source: /note="Description of Artificial Sequence: Synthetic oligonucleotide"
tctgggcagctcacctcc

SEQ ID NO: 1658 - DNA, 18 bp, Artificial Sequence
  source: /note="Description of Artificial Sequence: Synthetic oligonucleotide"
catctgggcagctcacct

SEQ ID NO: 1659 - DNA, 18 bp, Artificial Sequence
  source: /note="Description of Artificial Sequence: Synthetic oligonucleotide"
gccatctgggcagctcac

SEQ ID NO: 1660 - DNA, 18 bp, Artificial Sequence
  source: /note="Description of Artificial Sequence: Synthetic oligonucleotide"
tagccatctgggcagctc

SEQ ID NO: 1661 - DNA, 18 bp, Artificial Sequence
  source: /note="Description of Artificial Sequence: Synthetic oligonucleotide"
tatagccatctgggcagc

SEQ ID NO: 1662 - DNA, 18 bp, Artificial Sequence
  source: /note="Description of Artificial Sequence: Synthetic oligonucleotide"
ggtatagccatctgggca

SEQ ID NO: 1663 - DNA, 18 bp, Artificial Sequence
  source: /note="Description of Artificial Sequence: Synthetic oligonucleotide"
caggtatagccatctggg

SEQ ID NO: 1664 - DNA, 18 bp, Artificial Sequence
  source: /note="Description of Artificial Sequence: Synthetic oligonucleotide"
agcaggtatagccatctg

SEQ ID NO: 1665 - DNA, 18 bp, Artificial Sequence
  source: /note="Description of Artificial Sequence: Synthetic oligonucleotide"
gcagcaggtatagccatc

SEQ ID NO: 1666 - DNA, 18 bp, Artificial Sequence
  source: /note="Description of Artificial Sequence: Synthetic oligonucleotide"
cggcagcaggtatagcca

SEQ ID NO: 1667 - DNA, 18 bp, Artificial Sequence
  source: /note="Description of Artificial Sequence: Synthetic oligonucleotide"
gacggcagcaggtatagc

SEQ ID NO: 1668 - DNA, 18 bp, Artificial Sequence
  source: /note="Description of Artificial Sequence: Synthetic oligonucleotide"
tagacggcagcaggtata

SEQ ID NO: 1669 - DNA, 18 bp, Artificial Sequence
  source: /note="Description of Artificial Sequence: Synthetic oligonucleotide"
tgtagacggcagcaggta

SEQ ID NO: 1670 - DNA, 18 bp, Artificial Sequence
  source: /note="Description of Artificial Sequence: Synthetic oligonucleotide"
actgtagacggcagcagg

SEQ ID NO: 1671 - DNA, 18 bp, Artificial Sequence
  source: /note="Description of Artificial Sequence: Synthetic oligonucleotide"
cgactgtagacggcagca

SEQ ID NO: 1672 - DNA, 18 bp, Artificial Sequence
  source: /note="Description of Artificial Sequence: Synthetic oligonucleotide"
cccgactgtagacggcag

SEQ ID NO: 1673 - DNA, 18 bp, Artificial Sequence
  source: /note="Description of Artificial Sequence: Synthetic oligonucleotide"
cccccgactgtagacggc

SEQ ID NO: 1674 - DNA, 18 bp, Artificial Sequence
  source: /note="Description of Artificial Sequence: Synthetic oligonucleotide"
ggcccccgactgtagacg

SEQ ID NO: 1675 - DNA, 18 bp, Artificial Sequence
  source: /note="Description of Artificial Sequence: Synthetic oligonucleotide"
caggcccccgactgtaga

SEQ ID NO: 1676 - DNA, 18 bp, Artificial Sequence
  source: /note="Description of Artificial Sequence: Synthetic oligonucleotide"
cccaggcccccgactgta

SEQ ID NO: 1677 - DNA, 18 bp, Artificial Sequence
  source: /note="Description of Artificial Sequence: Synthetic oligonucleotide"
gccccaggcccccgactg

SEQ ID NO: 1678 - DNA, 18 bp, Artificial Sequence
  source: /note="Description of Artificial Sequence: Synthetic oligonucleotide"
cagccccaggcccccgac

SEQ ID NO: 1679 - DNA, 18 bp, Artificial Sequence
  source: /note="Description of Artificial Sequence: Synthetic oligonucleotide"
agcagccccaggcccccg

SEQ ID NO: 1680 - DNA, 18 bp, Artificial Sequence
  source: /note="Description of Artificial Sequence: Synthetic oligonucleotide"
gcagcagccccaggcccc

SEQ ID NO: 1681 - DNA, 18 bp, Artificial Sequence
  source: /note="Description of Artificial Sequence: Synthetic oligonucleotide"
gggcagcagccccaggcc

SEQ ID NO: 1682 - DNA, 18 bp, Artificial Sequence
  source: /note="Description of Artificial Sequence: Synthetic oligonucleotide"
aagggcagcagccccagg

SEQ ID NO: 1683 - DNA, 18 bp, Artificial Sequence
  source: /note="Description of Artificial Sequence: Synthetic oligonucleotide"
aaaagggcagcagcccca

SEQ ID NO: 1684 - DNA, 18 bp, Artificial Sequence
  source: /note="Description of Artificial Sequence: Synthetic oligonucleotide"
gtaaaagggcagcagccc

SEQ ID NO: 1685 - DNA, 18 bp, Artificial Sequence
  source: /note="Description of Artificial Sequence: Synthetic oligonucleotide"
gggtaaaagggcagcagc

SEQ ID NO: 1686 - DNA, 18 bp, Artificial Sequence
  source: /note="Description of Artificial Sequence: Synthetic oligonucleotide"
ctgggtaaaagggcagca

SEQ ID NO: 1687 - DNA, 18 bp, Artificial Sequence
  source: /note="Description of Artificial Sequence: Synthetic oligonucleotide"
acctgggtaaaagggcag

SEQ ID NO: 1688 - DNA, 18 bp, Artificial Sequence
  source: /note="Description of Artificial Sequence: Synthetic oligonucleotide"
gtacctgggtaaaagggc

SEQ ID NO: 1689 - DNA, 18 bp, Artificial Sequence
  source: /note="Description of Artificial Sequence: Synthetic oligonucleotide"
gggtacctgggtaaaagg

SEQ ID NO: 1690 - DNA, 18 bp, Artificial Sequence
  source: /note="Description of Artificial Sequence: Synthetic oligonucleotide"
ctgggtacctgggtaaaa

SEQ ID NO: 1691 - DNA, 18 bp, Artificial Sequence
  source: /note="Description of Artificial Sequence: Synthetic oligonucleotide"
ccctgggtacctgggtaa

SEQ ID NO: 1692 - DNA, 18 bp, Artificial Sequence
  source: /note="Description of Artificial Sequence: Synthetic oligonucleotide"
acccctgggtacctgggt

SEQ ID NO: 1693 - DNA, 18 bp, Artificial Sequence
  source: /note="Description of Artificial Sequence: Synthetic oligonucleotide"
ccacccctgggtacctgg

SEQ ID NO: 1694 - DNA, 18 bp, Artificial Sequence
  source: /note="Description of Artificial Sequence: Synthetic oligonucleotide"
cgccacccctgggtacct

SEQ ID NO: 1695 - DNA, 18 bp, Artificial Sequence
  source: /note="Description of Artificial Sequence: Synthetic oligonucleotide"
cccgccacccctgggtac

SEQ ID NO: 1696 - DNA, 18 bp, Artificial Sequence
  source: /note="Description of Artificial Sequence: Synthetic oligonucleotide"
cacccgccacccctgggt

SEQ ID NO: 1697 - DNA, 18 bp, Artificial Sequence
  source: /note="Description of Artificial Sequence: Synthetic oligonucleotide"
cccacccgccacccctgg

SEQ ID NO: 1698 - DNA, 18 bp, Artificial Sequence
  source: /note="Description of Artificial Sequence: Synthetic oligonucleotide"
cacccacccgccacccct

SEQ ID NO: 1699 - DNA, 18 bp, Artificial Sequence
  source: /note="Description of Artificial Sequence: Synthetic oligonucleotide"
cccacccacccgccaccc

SEQ ID NO: 1700 - DNA, 18 bp, Artificial Sequence
  source: /note="Description of Artificial Sequence: Synthetic oligonucleotide"
agcccacccacccgccac

SEQ ID NO: 1701 - DNA, 18 bp, Artificial Sequence
  source: /note="Description of Artificial Sequence: Synthetic oligonucleotide"
tcagcccacccacccgcc

SEQ ID NO: 1702 - DNA, 18 bp, Artificial Sequence
  source: /note="Description of Artificial Sequence: Synthetic oligonucleotide"
gctcagcccacccacccg

SEQ ID NO: 1703 - DNA, 18 bp, Artificial Sequence
  source: /note="Description of Artificial Sequence: Synthetic oligonucleotide"
gtgctcagcccacccacc

SEQ ID NO: 1704 - DNA, 18 bp, Artificial Sequence
  source: /note="Description of Artificial Sequence: Synthetic oligonucleotide"
ctgtgctcagcccaccca

SEQ ID NO: 1705 - DNA, 18 bp, Artificial Sequence
  source: /note="Description of Artificial Sequence: Synthetic oligonucleotide"
cactgtgctcagcccacc

SEQ ID NO: 1706 - DNA, 18 bp, Artificial Sequence
  source: /note="Description of Artificial Sequence: Synthetic oligonucleotide"
cacactgtgctcagccca

SEQ ID NO: 1707 - DNA, 18 bp, Artificial Sequence
  source: /note="Description of Artificial Sequence: Synthetic oligonucleotide"
gccacactgtgctcagcc

SEQ ID NO: 1708 - DNA, 18 bp, Artificial Sequence
  source: /note="Description of Artificial Sequence: Synthetic oligonucleotide"
ctgccacactgtgctcag

SEQ ID NO: 1709 - DNA, 18 bp, Artificial Sequence
  source: /note="Description of Artificial Sequence: Synthetic oligonucleotide"
gcctgccacactgtgctc

SEQ ID NO: 1710 - DNA, 18 bp, Artificial Sequence
  source: /note="Description of Artificial Sequence: Synthetic oligonucleotide"
ctgcctgccacactgtgc

SEQ ID NO: 1711 - DNA, 18 bp, Artificial Sequence
  source: /note="Description of Artificial Sequence: Synthetic oligonucleotide"
ggctgcctgccacactgt

SEQ ID NO: 1712 - DNA, 18 bp, Artificial Sequence
  source: /note="Description of Artificial Sequence: Synthetic oligonucleotide"
gggcccggctgcctgcca

SEQ ID NO: 1713 - DNA, 18 bp, Artificial Sequence
  source: /note="Description of Artificial Sequence: Synthetic oligonucleotide"
tggggcccggctgcctgc

SEQ ID NO: 1714 - DNA, 18 bp, Artificial Sequence
  source: /note="Description of Artificial Sequence: Synthetic oligonucleotide"
actggggcccggctgcct

SEQ ID NO: 1715 - DNA, 18 bp, Artificial Sequence
  source: /note="Description of Artificial Sequence: Synthetic oligonucleotide"
gcactggggcccggctgc

SEQ ID NO: 1716 - DNA, 18 bp, Artificial Sequence
  source: /note="Description of Artificial Sequence: Synthetic oligonucleotide"
gggcactggggcccggct

SEQ ID NO: 1717 - DNA, 18 bp, Artificial Sequence
  source: /note="Description of Artificial Sequence: Synthetic oligonucleotide"
gtgggcactggggcccgg

SEQ ID NO: 1718 - DNA, 18 bp, Artificial Sequence
  source: /note="Description of Artificial Sequence: Synthetic oligonucleotide"
aggtgggcactggggccc

SEQ ID NO: 1719 - DNA, 18 bp, Artificial Sequence
  source: /note="Description of Artificial Sequence: Synthetic oligonucleotide"
gcaggtgggcactggggc

SEQ ID NO: 1720 - DNA, 18 bp, Artificial Sequence
  source: /note="Description of Artificial Sequence: Synthetic oligonucleotide"
gggcaggtgggcactggg

SEQ ID NO: 1721 - DNA, 18 bp, Artificial Sequence
  source: /note="Description of Artificial Sequence: Synthetic oligonucleotide"
aagggcaggtgggcactg

SEQ ID NO: 1722 - DNA, 18 bp, Artificial Sequence
  source: /note="Description of Artificial Sequence: Synthetic oligonucleotide"
agaagggcaggtgggcac

SEQ ID NO: 1723 - DNA, 18 bp, Artificial Sequence
  source: /note="Description of Artificial Sequence: Synthetic oligonucleotide"
gaagaagggcaggtgggc

SEQ ID NO: 1724 - DNA, 18 bp, Artificial Sequence
  source: /note="Description of Artificial Sequence: Synthetic oligonucleotide"
atgaagaagggcaggtgg

SEQ ID NO: 1725 - DNA, 18 bp, Artificial Sequence
  source: /note="Description of Artificial Sequence: Synthetic oligonucleotide"
agatgaagaagggcaggt

SEQ ID NO: 1726 - DNA, 18 bp, Artificial Sequence
  source: /note="Description of Artificial Sequence: Synthetic oligonucleotide"
gcagatgaagaagggcag

SEQ ID NO: 1727 - DNA, 18 bp, Artificial Sequence
  source: /note="Description of Artificial Sequence: Synthetic oligonucleotide"
gggcagatgaagaagggc

SEQ ID NO: 1728 - DNA, 18 bp, Artificial Sequence
  source: /note="Description of Artificial Sequence: Synthetic oligonucleotide"
tagggcagatgaagaagg

SEQ ID NO: 1729 - DNA, 18 bp, Artificial Sequence
  source: /note="Description of Artificial Sequence: Synthetic oligonucleotide"
gtcctcacagcacacagc

SEQ ID NO: 1730 - DNA, 18 bp, Artificial Sequence
  source: /note="Description of Artificial Sequence: Synthetic oligonucleotide"
tggtcctcacagcacaca

SEQ ID NO: 1731 - DNA, 18 bp, Artificial Sequence
  source: /note="Description of Artificial Sequence: Synthetic oligonucleotide"
tgtggtcctcacagcaca

SEQ ID NO: 1732 - DNA, 18 bp, Artificial Sequence
  source: /note="Description of Artificial Sequence: Synthetic oligonucleotide"
tatgtggtcctcacagca

SEQ ID NO: 1733 - DNA, 18 bp, Artificial Sequence
  source: /note="Description of Artificial Sequence: Synthetic oligonucleotide"
tgtatgtggtcctcacag

SEQ ID NO: 1734 - DNA, 18 bp, Artificial Sequence
  source: /note="Description of Artificial Sequence: Synthetic oligonucleotide"
agtgtatgtggtcctcac

SEQ ID NO: 1735 - DNA, 18 bp, Artificial Sequence
  source: /note="Description of Artificial Sequence: Synthetic oligonucleotide"
gcagtgtatgtggtcctc

SEQ ID NO: 1736 - DNA, 18 bp, Artificial Sequence
  source: /note="Description of Artificial Sequence: Synthetic oligonucleotide"
cagcagtgtatgtggtcc

SEQ ID NO: 1737 - DNA, 18 bp, Artificial Sequence
  source: /note="Description of Artificial Sequence: Synthetic oligonucleotide"
gacagcagtgtatgtggt

SEQ ID NO: 1738 - DNA, 18 bp, Artificial Sequence
  source: /note="Description of Artificial Sequence: Synthetic oligonucleotide"
gggacagcagtgtatgtg

SEQ ID NO: 1739 - DNA, 18 bp, Artificial Sequence
  source: /note="Description of Artificial Sequence: Synthetic oligonucleotide"
gcgggacagcagtgtatg

SEQ ID NO: 1740 - DNA, 18 bp, Artificial Sequence
  source: /note="Description of Artificial Sequence: Synthetic oligonucleotide"
ccgcgggacagcagtgta

SEQ ID NO: 1741 - DNA, 18 bp, Artificial Sequence
  source: /note="Description of Artificial Sequence: Synthetic oligonucleotide"
ccccgcgggacagcagtg

SEQ ID NO: 1742 - DNA, 18 bp, Artificial Sequence
  source: /note="Description of Artificial Sequence: Synthetic oligonucleotide"
aaccccgcgggacagcag

SEQ ID NO: 1743 - DNA, 18 bp, Artificial Sequence
  source: /note="Description of Artificial Sequence: Synthetic oligonucleotide"
taaaccccgcgggacagc

SEQ ID NO: 1744 - DNA, 18 bp, Artificial Sequence
  source: /note="Description of Artificial Sequence: Synthetic oligonucleotide"
cgtaaaccccgcgggaca

SEQ ID NO: 1745 - DNA, 18 bp, Artificial Sequence
  source: /note="Description of Artificial Sequence: Synthetic oligonucleotide"
cacgtaaaccccgcggga

SEQ ID NO: 1746 - DNA, 18 bp, Artificial Sequence
  source: /note="Description of Artificial Sequence: Synthetic oligonucleotide"
cacacgtaaaccccgcgg

SEQ ID NO: 1747 - DNA, 18 bp, Artificial Sequence
  source: /note="Description of Artificial Sequence: Synthetic oligonucleotide"
gtcacacgtaaaccccgc

SEQ ID NO: 1748 - DNA, 18 bp, Artificial Sequence
  source: /note="Description of Artificial Sequence: Synthetic oligonucleotide"
gtgtcacacgtaaacccc

SEQ ID NO: 1749 - DNA, 18 bp, Artificial Sequence
  source: /note="Description of Artificial Sequence: Synthetic oligonucleotide"
gcgtgtcacacgtaaacc

SEQ ID NO: 1750 - DNA, 18 bp, Artificial Sequence
  source: /note="Description of Artificial Sequence: Synthetic oligonucleotide"
ctgcgtgtcacacgtaaa

SEQ ID NO: 1751 - DNA, 18 bp, Artificial Sequence
  source: /note="Description of Artificial Sequence: Synthetic oligonucleotide"
ttctgcgtgtcacacgta

SEQ ID NO: 1752 - DNA, 18 bp, Artificial Sequence
  source: /note="Description of Artificial Sequence: Synthetic oligonucleotide"
ccttctgcgtgtcacacg

SEQ ID NO: 1753 - DNA, 18 bp, Artificial Sequence
  source: /note="Description of Artificial Sequence: Synthetic oligonucleotide"
acccttctgcgtgtcaca

SEQ ID NO: 1754 - DNA, 18 bp, Artificial Sequence
  source: /note="Description of Artificial Sequence: Synthetic oligonucleotide"
gtacccttctgcgtgtca

SEQ ID NO: 1755 - DNA, 18 bp, Artificial Sequence
  source: /note="Description of Artificial Sequence: Synthetic oligonucleotide"
aggtacccttctgcgtgt

SEQ ID NO: 1756 - DNA, 18 bp, Artificial Sequence
  source: /note="Description of Artificial Sequence: Synthetic oligonucleotide"
acaggtacccttctgcgt

SEQ ID NO: 1757 - DNA, 18 bp, Artificial Sequence
  source: /note="Description of Artificial Sequence: Synthetic oligonucleotide"
tcacaggtacccttctgc

SEQ ID NO: 1758 - DNA, 18 bp, Artificial Sequence
  source: /note="Description of Artificial Sequence: Synthetic oligonucleotide"
gttcacaggtacccttct

SEQ ID NO: 1759 - DNA, 18 bp, Artificial Sequence
  source: /note="Description of Artificial Sequence: Synthetic oligonucleotide"
ctgttcacaggtaccctt

SEQ ID NO: 1760 - DNA, 18 bp, Artificial Sequence
  source: /note="Description of Artificial Sequence: Synthetic oligonucleotide"
ccctgttcacaggtaccc

SEQ ID NO: 1761 - DNA, 18 bp, Artificial Sequence
  source: /note="Description of Artificial Sequence: Synthetic oligonucleotide"
gcccctgttcacaggtac

SEQ ID NO: 1762 - DNA, 18 bp, Artificial Sequence
  source: /note="Description of Artificial Sequence: Synthetic oligonucleotide"
gggcccctgttcacaggt

SEQ ID NO: 1763 - DNA, 18 bp, Artificial Sequence
  source: /note="Description of Artificial Sequence: Synthetic oligonucleotide"
tggggcccctgttcacag

SEQ ID NO: 1764 - DNA, 18 bp, Artificial Sequence
  source: /note="Description of Artificial Sequence: Synthetic oligonucleotide"
ggtggggcccctgttcac

SEQ ID NO: 1765 - DNA, 18 bp, Artificial Sequence
  source: /note="Description of Artificial Sequence: Synthetic oligonucleotide"
ctggtggggcccctgttc

SEQ ID NO: 1766 - DNA, 18 bp, Artificial Sequence
  source: /note="Description of Artificial Sequence: Synthetic oligonucleotide"
acctggtggggcccctgt

SEQ ID NO: 1767 - DNA, 18 bp, Artificial Sequence
  source: /note="Description of Artificial Sequence: Synthetic oligonucleotide"
gcacctggtggggcccct

SEQ ID NO: 1768 - DNA, 18 bp, Artificial Sequence
  source: /note="Description of Artificial Sequence: Synthetic oligonucleotide"
gggcacctggtggggccc

SEQ ID NO: 1769 - DNA, 18 bp, Artificial Sequence
  source: /note="Description of Artificial Sequence: Synthetic oligonucleotide"
cagggcacctggtggggc

SEQ ID NO: 1770 - DNA, 18 bp, Artificial Sequence
  source: /note="Description of Artificial Sequence: Synthetic oligonucleotide"
tccagggcacctggtggg

SEQ ID NO: 1771 - DNA, 18 bp, Artificial Sequence
  source: /note="Description of Artificial Sequence: Synthetic oligonucleotide"
catccagggcacctggtg

SEQ ID NO: 1772 - DNA, 18 bp, Artificial Sequence
  source: /note="Description of Artificial Sequence: Synthetic oligonucleotide"
tccatccagggcacctgg

SEQ ID NO: 1773 - DNA, 18 bp, Artificial Sequence
  source: /note="Description of Artificial Sequence: Synthetic oligonucleotide"
tctccatccagggcacct

SEQ ID NO: 1774 - DNA, 18 bp, Artificial Sequence
  source: /note="Description of Artificial Sequence: Synthetic oligonucleotide"
cttctccatccagggcac

SEQ ID NO: 1775 - DNA, 18 bp, Artificial Sequence
  source: /note="Description of Artificial Sequence: Synthetic oligonucleotide"
gccttctccatccagggc

SEQ ID NO: 1776 - DNA, 18 bp, Artificial Sequence
  source: /note="Description of Artificial Sequence: Synthetic oligonucleotide"
gggccttctccatccagg

SEQ ID NO: 1777 - DNA, 18 bp, Artificial Sequence
  source: /note="Description of Artificial Sequence: Synthetic oligonucleotide"
tggggccttctccatcca

SEQ ID NO: 1778 - DNA, 18 bp, Artificial Sequence
  source: /note="Description of Artificial Sequence: Synthetic oligonucleotide"
gctggggccttctccatc

SEQ ID NO: 1779 - DNA, 18 bp, Artificial Sequence
  source: /note="Description of Artificial Sequence: Synthetic oligonucleotide"
gagctggggccttctcca

SEQ ID NO: 1780 - DNA, 18 bp, Artificial Sequence
  source: /note="Description of Artificial Sequence: Synthetic oligonucleotide"
gtgagctggggccttctc

SEQ ID NO: 1781 - DNA, 18 bp, Artificial Sequence
  source: /note="Description of Artificial Sequence: Synthetic oligonucleotide"
aggtgagctggggccttc

SEQ ID NO: 1782 - DNA, 18 bp, Artificial Sequence
  source: /note="Description of Artificial Sequence: Synthetic oligonucleotide"
tgaggtgagctggggcct

SEQ ID NO: 1783 - DNA, 18 bp, Artificial Sequence
  source: /note="Description of Artificial Sequence: Synthetic oligonucleotide"
gctgaggtgagctggggc

SEQ ID NO: 1784 - DNA, 18 bp, Artificial Sequence
  source: /note="Description of Artificial Sequence: Synthetic oligonucleotide"
aggctgaggtgagctggg

SEQ ID NO: 1785 - DNA, 18 bp, Artificial Sequence
  source: /note="Description of Artificial Sequence: Synthetic oligonucleotide"
gcaggctgaggtgagctg

SEQ ID NO: 1786 - DNA, 18 bp, Artificial Sequence
  source: /note="Description of Artificial Sequence: Synthetic oligonucleotide"
tggcaggctgaggtgagc

SEQ ID NO: 1787 - DNA, 18 bp, Artificial Sequence
  source: /note="Description of Artificial Sequence: Synthetic oligonucleotide"
tctggcaggctgaggtga

SEQ ID NO: 1788 - DNA, 18 bp, Artificial Sequence
  source: /note="Description of Artificial Sequence: Synthetic oligonucleotide"
ggtctggcaggctgaggt

SEQ ID NO: 1789 - DNA, 18 bp, Artificial Sequence
  source: /note="Description of Artificial Sequence: Synthetic oligonucleotide"
tgggtctggcaggctgag

SEQ ID NO: 1790 - DNA, 18 bp, Artificial Sequence
  source: /note="Description of Artificial Sequence: Synthetic oligonucleotide"
tgtgggtctggcaggctg

SEQ ID NO: 1791 - DNA, 18 bp, Artificial Sequence
  source: /note="Description of Artificial Sequence: Synthetic oligonucleotide"
cttgtgggtctggcaggc

SEQ ID NO: 1792 - DNA, 18 bp, Artificial Sequence
  source: /note="Description of Artificial Sequence: Synthetic oligonucleotide"
ggcttgtgggtctggcag

SEQ ID NO: 1793 - DNA, 18 bp, Artificial Sequence
  source: /note="Description of Artificial Sequence: Synthetic oligonucleotide"
aaggcttgtgggtctggc

SEQ ID NO: 1794 - DNA, 18 bp, Artificial Sequence
  source: /note="Description of Artificial Sequence: Synthetic oligonucleotide"
tcaaggcttgtgggtctg

SEQ ID NO: 1795 - DNA, 18 bp, Artificial Sequence
  source: /note="Description of Artificial Sequence: Synthetic oligonucleotide"
cttcaaggcttgtgggtc

SEQ ID NO: 1796 - DNA, 18 bp, Artificial Sequence
  source: /note="Description of Artificial Sequence: Synthetic oligonucleotide"
ctcttcaaggcttgtggg

SEQ ID NO: 1797 - DNA, 18 bp, Artificial Sequence
  source: /note="Description of Artificial Sequence: Synthetic oligonucleotide"
ctctcttcaaggcttgtg

SEQ ID NO: 1798 - DNA, 18 bp, Artificial Sequence
  source: /note="Description of Artificial Sequence: Synthetic oligonucleotide"
atctctcttcaaggcttg

SEQ ID NO: 1799 - DNA, 18 bp, Artificial Sequence
  source: /note="Description of Artificial Sequence: Synthetic oligonucleotide"
acatctctcttcaaggct

SEQ ID NO: 1800 - DNA, 18 bp, Artificial Sequence
  source: /note="Description of Artificial Sequence: Synthetic oligonucleotide"
ggacatctctcttcaagg

SEQ ID NO: 1801 - DNA, 18 bp, Artificial Sequence
  source: /note="Description of Artificial Sequence: Synthetic oligonucleotide"
ggggacatctctcttcaa

SEQ ID NO: 1802 - DNA, 18 bp, Artificial Sequence
  source: /note="Description of Artificial Sequence: Synthetic oligonucleotide"
caggggacatctctcttc

SEQ ID NO: 1803 - DNA, 18 bp, Artificial Sequence
  source: /note="Description of Artificial Sequence: Synthetic oligonucleotide"
cacaggggacatctctct

SEQ ID NO: 1804 - DNA, 18 bp, Artificial Sequence
  source: /note="Description of Artificial Sequence: Synthetic oligonucleotide"
atcacaggggacatctct

SEQ ID NO: 1805 - DNA, 18 bp, Artificial Sequence
  source: /note="Description of Artificial Sequence: Synthetic oligonucleotide"
ttatcacaggggacatct

SEQ ID NO: 1806 - DNA, 18 bp, Artificial Sequence
  source: /note="Description of Artificial Sequence: Synthetic oligonucleotide"
cattatcacaggggacat

SEQ ID NO: 1807 - DNA, 18 bp, Artificial Sequence
  source: /note="Description of Artificial Sequence: Synthetic oligonucleotide"
gacattatcacaggggac

SEQ ID NO: 1808 - DNA, 18 bp, Artificial Sequence
  source: /note="Description of Artificial Sequence: Synthetic oligonucleotide"
ctgacattatcacagggg

SEQ ID NO: 1809 - DNA, 18 bp, Artificial Sequence
  source: /note="Description of Artificial Sequence: Synthetic oligonucleotide"
tgctgacattatcacagg

SEQ ID NO: 1810 - DNA, 18 bp, Artificial Sequence
  source: /note="Description of Artificial Sequence: Synthetic oligonucleotide"
gctgctgacattatcaca

SEQ ID NO: 1811 - DNA, 18 bp, Artificial Sequence
  source: /note="Description of Artificial Sequence: Synthetic oligonucleotide"
cagctgctgacattatca

SEQ ID NO: 1812 - DNA, 18 bp, Artificial Sequence
  source: /note="Description of Artificial Sequence: Synthetic oligonucleotide"
gacagctgctgacattat

SEQ ID NO: 1813 - DNA, 18 bp, Artificial Sequence
  source: /note="Description of Artificial Sequence: Synthetic oligonucleotide"
gggacagctgctgacatt

SEQ ID NO: 1814 - DNA, 18 bp, Artificial Sequence
  source: /note="Description of Artificial Sequence: Synthetic oligonucleotide"
gagggacagctgctgaca

SEQ ID NO: 1815 - DNA, 18 bp, Artificial Sequence
  source: /note="Description of Artificial Sequence: Synthetic oligonucleotide"
aggagggacagctgctga

SEQ ID NO: 1816 - DNA, 18 bp, Artificial Sequence
  source: /note="Description of Artificial Sequence: Synthetic oligonucleotide"
ggaggagggacagctgct

SEQ ID NO: 1817 - DNA, 18 bp, Artificial Sequence
  source: /note="Description of Artificial Sequence: Synthetic oligonucleotide"
tcggaggagggacagctg

SEQ ID NO: 1818 - DNA, 18 bp, Artificial Sequence
  source: /note="Description of Artificial Sequence: Synthetic oligonucleotide"
tatcggaggagggacagc

SEQ ID NO: 1819 - DNA, 18 bp, Artificial Sequence
  source: /note="Description of Artificial Sequence: Synthetic oligonucleotide"
ggtatcggaggagggaca

SEQ ID NO: 1820 - DNA, 18 bp, Artificial Sequence
  source: /note="Description of Artificial Sequence: Synthetic oligonucleotide"
caggtatcggaggaggga

SEQ ID NO: 1821 - DNA, 18 bp, Artificial Sequence
  source: /note="Description of Artificial Sequence: Synthetic oligonucleotide"
agcaggtatcggaggagg

SEQ ID NO: 1822 - DNA, 18 bp, Artificial Sequence
  source: /note="Description of Artificial Sequence: Synthetic oligonucleotide"
gcagcaggtatcggagga

SEQ ID NO: 1823 - DNA, 18 bp, Artificial Sequence
  source: /note="Description of Artificial Sequence: Synthetic oligonucleotide"
tggcagcaggtatcggag

SEQ ID NO: 1824 - DNA, 18 bp, Artificial Sequence
  source: /note="Description of Artificial Sequence: Synthetic oligonucleotide"
gttggcagcaggtatcgg

SEQ ID NO: 1825 - DNA, 18 bp, Artificial Sequence
  source: /note="Description of Artificial Sequence: Synthetic oligonucleotide"
gagttggcagcaggtatc

SEQ ID NO: 1826 - DNA, 18 bp, Artificial Sequence
  source: /note="Description of Artificial Sequence: Synthetic oligonucleotide"
gtgagttggcagcaggta

SEQ ID NO: 1827 - DNA, 18 bp, Artificial Sequence
  source: /note="Description of Artificial Sequence: Synthetic oligonucleotide"
acgtgagttggcagcagg

SEQ ID NO: 1828 - DNA, 18 bp, Artificial Sequence
  source: /note="Description of Artificial Sequence: Synthetic oligonucleotide"
agacgtgagttggcagca

SEQ ID NO: 1829 - DNA, 18 bp, Artificial Sequence
  source: /note="Description of Artificial Sequence: Synthetic oligonucleotide"
ccagacgtgagttggcag

SEQ ID NO: 1830 - DNA, 18 bp, Artificial Sequence
  source: /note="Description of Artificial Sequence: Synthetic oligonucleotide"
ccccagacgtgagttggc

SEQ ID NO: 1831 - DNA, 18 bp, Artificial Sequence
  source: /note="Description of Artificial Sequence: Synthetic oligonucleotide"
ctccccagacgtgagttg

SEQ ID NO: 1832 - DNA, 18 bp, Artificial Sequence
  source: /note="Description of Artificial Sequence: Synthetic oligonucleotide"
cactccccagacgtgagt

SEQ ID NO: 1833 - DNA, 18 bp, Artificial Sequence
  source: /note="Description of Artificial Sequence: Synthetic oligonucleotide"
cccactccccagacgtga

SEQ ID NO: 1834 - DNA, 18 bp, Artificial Sequence
  source: /note="Description of Artificial Sequence: Synthetic oligonucleotide"
gccccactccccagacgt

SEQ ID NO: 1835 - DNA, 18 bp, Artificial Sequence
  source: /note="Description of Artificial Sequence: Synthetic oligonucleotide"
cagccccactccccagac

SEQ ID NO: 1836 - DNA, 18 bp, Artificial Sequence
  source: /note="Description of Artificial Sequence: Synthetic oligonucleotide"
agcagccccactccccag

SEQ ID NO: 1837 - DNA, 18 bp, Artificial Sequence
  source: /note="Description of Artificial Sequence: Synthetic oligonucleotide"
acagcagccccactcccc

SEQ ID NO: 1838 - DNA, 18 bp, Artificial Sequence
  source: /note="Description of Artificial Sequence: Synthetic oligonucleotide"
ggacagcagccccactcc

SEQ ID NO: 1839 - DNA, 18 bp, Artificial Sequence
  source: /note="Description of Artificial Sequence: Synthetic oligonucleotide"
ttggacagcagccccact

SEQ ID NO: 1840 - DNA, 18 bp, Artificial Sequence
  source: /note="Description of Artificial Sequence: Synthetic oligonucleotide"
gattggacagcagcccca

SEQ ID NO: 1841 - DNA, 18 bp, Artificial Sequence
  source: /note="Description of Artificial Sequence: Synthetic oligonucleotide"
gggattggacagcagccc

SEQ ID NO: 1842 - DNA, 18 bp, Artificial Sequence
  source: /note="Description of Artificial Sequence: Synthetic oligonucleotide"
ctgggattggacagcagc

SEQ ID NO: 1843 - DNA, 18 bp, Artificial Sequence
  source: /note="Description of Artificial Sequence: Synthetic oligonucleotide"
ctctgggattggacagca

SEQ ID NO: 1844 - DNA, 18 bp, Artificial Sequence
  source: /note="Description of Artificial Sequence: Synthetic oligonucleotide"
gctgtcccctcccatata

SEQ ID NO: 1845 - DNA, 18 bp, Artificial Sequence
  source: /note="Description of Artificial Sequence: Synthetic oligonucleotide"
atgctgtcccctcccata

SEQ ID NO: 1846 - DNA, 18 bp, Artificial Sequence
  source: /note="Description of Artificial Sequence: Synthetic oligonucleotide"
agatgctgtcccctccca

SEQ ID NO: 1847 - DNA, 18 bp, Artificial Sequence
  source: /note="Description of Artificial Sequence: Synthetic oligonucleotide"
caagatgctgtcccctcc

SEQ ID NO: 1848 - DNA, 18 bp, Artificial Sequence
  source: /note="Description of Artificial Sequence: Synthetic oligonucleotide"
gccaagatgctgtcccct

SEQ ID NO: 1849 - DNA, 18 bp, Artificial Sequence
  source: /note="Description of Artificial Sequence: Synthetic oligonucleotide"
aggccaagatgctgtccc

SEQ ID NO: 1850 - DNA, 18 bp, Artificial Sequence
  source: /note="Description of Artificial Sequence: Synthetic oligonucleotide"
ccaggccaagatgctgtc

SEQ ID NO: 1851 - DNA, 18 bp, Artificial Sequence
  source: /note="Description of Artificial Sequence: Synthetic oligonucleotide"
gcccaggccaagatgctg

SEQ ID NO: 1852 - DNA, 18 bp, Artificial Sequence
  source: /note="Description of Artificial Sequence: Synthetic oligonucleotide"
ctgcccaggccaagatgc

SEQ ID NO: 1853 - DNA, 18 bp, Artificial Sequence
  source: /note="Description of Artificial Sequence: Synthetic oligonucleotide"
acctgcccaggccaagat

SEQ ID NO: 1854 - DNA, 18 bp, Artificial Sequence
  source: /note="Description of Artificial Sequence: Synthetic oligonucleotide"
ccacctgcccaggccaag

SEQ ID NO: 1855 - DNA, 18 bp, Artificial Sequence
  source: /note="Description of Artificial Sequence: Synthetic oligonucleotide"
acccacctgcccaggcca

SEQ ID NO: 1856 - DNA, 18 bp, Artificial Sequence
  source: /note="Description of Artificial Sequence: Synthetic oligonucleotide"
ccacccacctgcccaggc

SEQ ID NO: 1857 - DNA, 18 bp, Artificial Sequence
  source: /note="Description of Artificial Sequence: Synthetic oligonucleotide"
ggccacccacctgcccag

SEQ ID NO: 1858 - DNA, 18 bp, Artificial Sequence
  source: /note="Description of Artificial Sequence: Synthetic oligonucleotide"
ttggccacccacctgccc

SEQ ID NO: 1859 - DNA, 18 bp, Artificial Sequence
  source: /note="Description of Artificial Sequence: Synthetic oligonucleotide"
gcttggccacccacctgc

SEQ ID NO: 1860 - DNA, 18 bp, Artificial Sequence
  source: /note="Description of Artificial Sequence: Synthetic oligonucleotide"
gagcttggccacccacct

SEQ ID NO: 1861 - DNA, 18 bp, Artificial Sequence
  source: /note="Description of Artificial Sequence: Synthetic oligonucleotide"
agccactatgtggggcgc

SEQ ID NO: 1862 - DNA, 18 bp, Artificial Sequence
  source: /note="Description of Artificial Sequence: Synthetic oligonucleotide"
gtagccactatgtggggc

SEQ ID NO: 1863 - DNA, 18 bp, Artificial Sequence
  source: /note="Description of Artificial Sequence: Synthetic oligonucleotide"
aggtagccactatgtggg

SEQ ID NO: 1864 - DNA, 18 bp, Artificial Sequence
  source: /note="Description of Artificial Sequence: Synthetic oligonucleotide"
gtaggtagccactatgtg

SEQ ID NO: 1865 - DNA, 18 bp, Artificial Sequence
  source: /note="Description of Artificial Sequence: Synthetic oligonucleotide"
ttgtaggtagccactatg

SEQ ID NO: 1866 - DNA, 18 bp, Artificial Sequence
  source: /note="Description of Artificial Sequence: Synthetic oligonucleotide"
cgttgtaggtagccacta

SEQ ID NO: 1867 - DNA, 18 bp, Artificial Sequence
  source: /note="Description of Artificial Sequence: Synthetic oligonucleotide"
ggcgttgtaggtagccac

SEQ ID NO: 1868 - DNA, 18 bp, Artificial Sequence
  source: /note="Description of Artificial Sequence: Synthetic oligonucleotide"
agggcgttgtaggtagcc

SEQ ID NO: 1869 - DNA, 18 bp, Artificial Sequence
  source: /note="Description of Artificial Sequence: Synthetic oligonucleotide"
aaagggcgttgtaggtag

SEQ ID NO: 1870 - DNA, 18 bp, Artificial Sequence
  source: /note="Description of Artificial Sequence: Synthetic oligonucleotide"
ggaaagggcgttgtaggt

SEQ ID NO: 1871 - DNA, 18 bp, Artificial Sequence
  source: /note="Description of Artificial Sequence: Synthetic oligonucleotide"
caggaaagggcgttgtag

SEQ ID NO: 1872 - DNA, 18 bp, Artificial Sequence
  source: /note="Description of Artificial Sequence: Synthetic oligonucleotide"
ggcaggaaagggcgttgt

SEQ ID NO: 1873 - DNA, 18 bp, Artificial Sequence
  source: /note="Description of Artificial Sequence: Synthetic oligonucleotide"
tgggcaggaaagggcgtt

SEQ ID NO: 1874 - DNA, 18 bp, Artificial Sequence
  source: /note="Description of Artificial Sequence: Synthetic oligonucleotide"
ggtgggcaggaaagggcg

SEQ ID NO: 1875 - DNA, 18 bp, Artificial Sequence
  source: /note="Description of Artificial Sequence: Synthetic oligonucleotide"
ggggtgggcaggaaaggg

SEQ ID NO: 1876 - DNA, 18 bp, Artificial Sequence
  source: /note="Description of Artificial Sequence: Synthetic oligonucleotide"
ggggggtgggcaggaaag

SEQ ID NO: 1877 - DNA, 18 bp, Artificial Sequence
  source: /note="Description of Artificial Sequence: Synthetic oligonucleotide"
ctggggggtgggcaggaa

SEQ ID NO: 1878 - DNA, 18 bp, Artificial Sequence
  source: /note="Description of Artificial Sequence: Synthetic oligonucleotide"
ggtccgagcagcagacag

SEQ ID NO: 1879 - DNA, 18 bp, Artificial Sequence
  source: /note="Description of Artificial Sequence: Synthetic oligonucleotide"
gtggtccgagcagcagac

SEQ ID NO: 1880 - DNA, 18 bp, Artificial Sequence
  source: /note="Description of Artificial Sequence: Synthetic oligonucleotide"
tggtggtccgagcagcag

SEQ ID NO: 1881 - DNA, 18 bp, Artificial Sequence
  source: /note="Description of Artificial Sequence: Synthetic oligonucleotide"
gctggtggtccgagcagc

SEQ ID NO: 1882 - DNA, 18 bp, Artificial Sequence
  source: /note="Description of Artificial Sequence: Synthetic oligonucleotide"
gtgctggtggtccgagca

SEQ ID NO: 1883 - DNA, 18 bp, Artificial Sequence
  source: /note="Description of Artificial Sequence: Synthetic oligonucleotide"
cagtgctggtggtccgag

SEQ ID NO: 1884 - DNA, 18 bp, Artificial Sequence
  source: /note="Description of Artificial Sequence: Synthetic oligonucleotide"
agcagtgctggtggtccg

SEQ ID NO: 1885 - DNA, 18 bp, Artificial Sequence
  source: /note="Description of Artificial Sequence: Synthetic oligonucleotide"
gcagcagtgctggtggtc

SEQ ID NO: 1886 - DNA, 18 bp, Artificial Sequence
  source: /note="Description of Artificial Sequence: Synthetic oligonucleotide"
gggcagcagtgctggtgg

SEQ ID NO: 1887 - DNA, 18 bp, Artificial Sequence
  source: /note="Description of Artificial Sequence: Synthetic oligonucleotide"
gggggcagcagtgctggt

SEQ ID NO: 1888 - DNA, 18 bp, Artificial Sequence
  source: /note="Description of Artificial Sequence: Synthetic oligonucleotide"
ctgggggcagcagtgctg

SEQ ID NO: 1889 - DNA, 18 bp, Artificial Sequence
  source: /note="Description of Artificial Sequence: Synthetic oligonucleotide"
ccctgggggcagcagtgc

SEQ ID NO: 1890 - DNA, 18 bp, Artificial Sequence
  source: /note="Description of Artificial Sequence: Synthetic oligonucleotide"
agccctgggggcagcagt

SEQ ID NO: 1891 - DNA, 18 bp, Artificial Sequence
  source: /note="Description of Artificial Sequence: Synthetic oligonucleotide"
gtagccctgggggcagca

SEQ ID NO: 1892 - DNA, 18 bp, Artificial Sequence
  source: /note="Description of Artificial Sequence: Synthetic oligonucleotide"
gtgtagccctgggggcag

SEQ ID NO: 1893 - DNA, 18 bp, Artificial Sequence
  source: /note="Description of Artificial Sequence: Synthetic oligonucleotide"
acgtgtagccctgggggc

SEQ ID NO: 1894 - DNA, 18 bp, Artificial Sequence
  source: /note="Description of Artificial Sequence: Synthetic oligonucleotide"
acacgtgtagccctgggg

SEQ ID NO: 1895 - DNA, 18 bp, Artificial Sequence
  source: /note="Description of Artificial Sequence: Synthetic oligonucleotide"
acacacgtgtagccctgg

SEQ ID NO: 1896 - DNA, 18 bp, Artificial Sequence
  source: /note="Description of Artificial Sequence: Synthetic oligonucleotide"
ctacacacgtgtagccct

SEQ ID NO: 1897 - DNA, 18 bp, Artificial Sequence
  source: /note="Description of Artificial Sequence: Synthetic oligonucleotide"
agctacacacgtgtagcc

SEQ ID NO: 1898 - DNA, 18 bp, Artificial Sequence
  source: /note="Description of Artificial Sequence: Synthetic oligonucleotide"
tcagctacacacgtgtag

SEQ ID NO: 1899 - DNA, 18 bp, Artificial Sequence
  source: /note="Description of Artificial Sequence: Synthetic oligonucleotide"
cctcagctacacacgtgt

SEQ ID NO: 1900 - DNA, 18 bp, Artificial Sequence
  source: /note="Description of Artificial Sequence: Synthetic oligonucleotide"
cccctcagctacacacgt

SEQ ID NO: 1901 - DNA, 18 bp, Artificial Sequence
  source: /note="Description of Artificial Sequence: Synthetic oligonucleotide"
tgcccctcagctacacac

SEQ ID NO: 1902 - DNA, 18 bp, Artificial Sequence
  source: /note="Description of Artificial Sequence: Synthetic oligonucleotide"
actgcccctcagctacac

SEQ ID NO: 1903 - DNA, 18 bp, Artificial Sequence
  source: /note="Description of Artificial Sequence: Synthetic oligonucleotide"
acactgcccctcagctac

SEQ ID NO: 1904 - DNA, 18 bp, Artificial Sequence
  source: /note="Description of Artificial Sequence: Synthetic oligonucleotide"
tgacactgcccctcagct

SEQ ID NO: 1905 - DNA, 18 bp, Artificial Sequence
  source: /note="Description of Artificial Sequence: Synthetic oligonucleotide"
gctgacactgcccctcag

SEQ ID NO: 1906 - DNA, 18 bp, Artificial Sequence
  source: /note="Description of Artificial Sequence: Synthetic oligonucleotide"
tcgctgacactgcccctc

SEQ ID NO: 1907 - DNA, 18 bp, Artificial Sequence
  source: /note="Description of Artificial Sequence: Synthetic oligonucleotide"
cctcgctgacactgcccc

SEQ ID NO: 1908 - DNA, 18 bp, Artificial Sequence
  source: /note="Description of Artificial Sequence: Synthetic oligonucleotide"
ttcctcgctgacactgcc

SEQ ID NO: 1909 - DNA, 18 bp, Artificial Sequence
  source: /note="Description of Artificial Sequence: Synthetic oligonucleotide"
gcttcctcgctgacactg

SEQ ID NO: 1910 - DNA, 18 bp, Artificial Sequence
  source: /note="Description of Artificial Sequence: Synthetic oligonucleotide"
tcgcttcctcgctgacac

SEQ ID NO: 1911 - DNA, 18 bp, Artificial Sequence
  source: /note="Description of Artificial Sequence: Synthetic oligonucleotide"
tctcgcttcctcgctgac

SEQ ID NO: 1912 - DNA, 18 bp, Artificial Sequence
  source: /note="Description of Artificial Sequence: Synthetic oligonucleotide"
gatctcgcttcctcgctg

SEQ ID NO: 1913 - DNA, 18 bp, Artificial Sequence
  source: /note="Description of Artificial Sequence: Synthetic oligonucleotide"
acgatctcgcttcctcgc

SEQ ID NO: 1914 - DNA, 18 bp, Artificial Sequence
  source: /note="Description of Artificial Sequence: Synthetic oligonucleotide"
ccacgatctcgcttcctc

SEQ ID NO: 1915 - DNA, 18 bp, Artificial Sequence
  source: /note="Description of Artificial Sequence: Synthetic oligonucleotide"
agccacgatctcgcttcc

SEQ ID NO: 1916 - DNA, 18 bp, Artificial Sequence
  source: /note="Description of Artificial Sequence: Synthetic oligonucleotide"
ccagccacgatctcgctt

SEQ ID NO: 1917 - DNA, 18 bp, Artificial Sequence
  source: /note="Description of Artificial Sequence: Synthetic oligonucleotide"
gtccagccacgatctcgc

SEQ ID NO: 1918 - DNA, 18 bp, Artificial Sequence
  source: /note="Description of Artificial Sequence: Synthetic oligonucleotide"
cagtccagccacgatctc

SEQ ID NO: 1919 - DNA, 18 bp, Artificial Sequence
  source: /note="Description of Artificial Sequence: Synthetic oligonucleotide"
tccagtccagccacgatc

SEQ ID NO: 1920 - DNA, 18 bp, Artificial Sequence
  source: /note="Description of Artificial Sequence: Synthetic oligonucleotide"
tctccagtccagccacga

SEQ ID NO: 1921 - DNA, 18 bp, Artificial Sequence
  source: /note="Description of Artificial Sequence: Synthetic oligonucleotide"
cttctccagtccagccac

SEQ ID NO: 1922 - DNA, 18 bp, Artificial Sequence
  source: /note="Description of Artificial Sequence: Synthetic oligonucleotide"
atcttctccagtccagcc

SEQ ID NO: 1923 - DNA, 18 bp, Artificial Sequence
  source: /note="Description of Artificial Sequence: Synthetic oligonucleotide"
gcatcttctccagtccag

SEQ ID NO: 1924 - DNA, 18 bp, Artificial Sequence
  source: /note="Description of Artificial Sequence: Synthetic oligonucleotide"
aggcatcttctccagtcc

SEQ ID NO: 1925 - DNA, 18 bp, Artificial Sequence
  source: /note="Description of Artificial Sequence: Synthetic oligonucleotide"
gcaggcatcttctccagt

SEQ ID NO: 1926 - DNA, 18 bp, Artificial Sequence
  source: /note="Description of Artificial Sequence: Synthetic oligonucleotide"
gggcaggcatcttctcca

SEQ ID NO: 1927 - DNA, 18 bp, Artificial Sequence
  source: /note="Description of Artificial Sequence: Synthetic oligonucleotide"
gcgggcaggcatcttctc

SEQ ID NO: 1928 - DNA, 18 bp, Artificial Sequence
  source: /note="Description of Artificial Sequence: Synthetic oligonucleotide"
cggcgggcaggcatcttc

SEQ ID NO: 1929 - DNA, 18 bp, Artificial Sequence
  source: /note="Description of Artificial Sequence: Synthetic oligonucleotide"
cccggcgggcaggcatct

SEQ ID NO: 1930 - DNA, 18 bp, Artificial Sequence
  source: /note="Description of Artificial Sequence: Synthetic oligonucleotide"
agcccggcgggcaggcat

SEQ ID NO: 1931 - DNA, 18 bp, Artificial Sequence
  source: /note="Description of Artificial Sequence: Synthetic oligonucleotide"
gaagcccggcgggcaggc

SEQ ID NO: 1932 - DNA, 18 bp, Artificial Sequence
  source: /note="Description of Artificial Sequence: Synthetic oligonucleotide"
aggaagcccggcgggcag

SEQ ID NO: 1933 - DNA, 18 bp, Artificial Sequence
  source: /note="Description of Artificial Sequence: Synthetic oligonucleotide"
taaggaagcccggcgggc

SEQ ID NO: 1934 - DNA, 18 bp, Artificial Sequence
  source: /note="Description of Artificial Sequence: Synthetic oligonucleotide"
gataaggaagcccggcgg

SEQ ID NO: 1935 - DNA, 18 bp, Artificial Sequence
  source: /note="Description of Artificial Sequence: Synthetic oligonucleotide"
gggataaggaagcccggc

SEQ ID NO: 1936 - DNA, 18 bp, Artificial Sequence
  source: /note="Description of Artificial Sequence: Synthetic oligonucleotide"
gtgggataaggaagcccg

SEQ ID NO: 1937 - DNA, 18 bp, Artificial Sequence
  source: /note="Description of Artificial Sequence: Synthetic oligonucleotide"
gggtgggataaggaagcc

SEQ ID NO: 1938 - DNA, 18 bp, Artificial Sequence
  source: /note="Description of Artificial Sequence: Synthetic oligonucleotide"
tggggtgggataaggaag

SEQ ID NO: 1939 - DNA, 18 bp, Artificial Sequence
  source: /note="Description of Artificial Sequence: Synthetic oligonucleotide"
tctggggtgggataagga

SEQ ID NO: 1940 - DNA, 18 bp, Artificial Sequence
  source: /note="Description of Artificial Sequence: Synthetic oligonucleotide"
tctctggggtgggataag

SEQ ID NO: 1941 - DNA, 18 bp, Artificial Sequence
  source: /note="Description of Artificial Sequence: Synthetic oligonucleotide"
tgtctctggggtgggata

SEQ ID NO: 1942 - DNA, 18 bp, Artificial Sequence
  source: /note="Description of Artificial Sequence: Synthetic oligonucleotide"
gatgtctctggggtggga

SEQ ID NO: 1943 - DNA, 18 bp, Artificial Sequence
  source: /note="Description of Artificial Sequence: Synthetic oligonucleotide"
ccgatgtctctggggtgg

SEQ ID NO: 1944 - DNA, 18 bp, Artificial Sequence
  source: /note="Description of Artificial Sequence: Synthetic oligonucleotide"
agccgatgtctctggggt

SEQ ID NO: 1945 - DNA, 18 bp, Artificial Sequence
  source: /note="Description of Artificial Sequence: Synthetic oligonucleotide"
acagccgatgtctctggg

SEQ ID NO: 1946 - DNA, 18 bp, Artificial Sequence
  source: /note="Description of Artificial Sequence: Synthetic oligonucleotide"
tcacagccgatgtctctg

SEQ ID NO: 1947 - DNA, 18 bp, Artificial Sequence
  source: /note="Description of Artificial Sequence: Synthetic oligonucleotide"
ggtcacagccgatgtctc

SEQ ID NO: 1948 - DNA, 18 bp, Artificial Sequence
  source: /note="Description of Artificial Sequence: Synthetic oligonucleotide"
ctggtcacagccgatgtc

SEQ ID NO: 1949 - DNA, 18 bp, Artificial Sequence
  source: /note="Description of Artificial Sequence: Synthetic oligonucleotide"
tgctggtcacagccgatg

SEQ ID NO: 1950 - DNA, 18 bp, Artificial Sequence
  source: /note="Description of Artificial Sequence: Synthetic oligonucleotide"
tgtgctggtcacagccga

SEQ ID NO: 1951 - DNA, 18 bp, Artificial Sequence
  source: /note="Description of Artificial Sequence: Synthetic oligonucleotide"
ggtgtgctggtcacagcc

SEQ ID NO: 1952 - DNA, 18 bp, Artificial Sequence
  source: /note="Description of Artificial Sequence: Synthetic oligonucleotide"
ctggtgtgctggtcacag

SEQ ID NO: 1953 - DNA, 18 bp, Artificial Sequence
  source: /note="Description of Artificial Sequence: Synthetic oligonucleotide"
agctggtgtgctggtcac

SEQ ID NO: 1954 - DNA, 18 bp, Artificial Sequence
  source: /note="Description of Artificial Sequence: Synthetic oligonucleotide"
gcagctggtgtgctggtc

SEQ ID NO: 1955 - DNA, 18 bp, Artificial Sequence
  source: /note="Description of Artificial Sequence: Synthetic oligonucleotide"
gggcagctggtgtgctgg

SEQ ID NO: 1956 - DNA, 18 bp, Artificial Sequence
  source: /note="Description of Artificial Sequence: Synthetic oligonucleotide"
ccgggcagctggtgtgct

SEQ ID NO: 1957 - DNA, 18 bp, Artificial Sequence
  source: /note="Description of Artificial Sequence: Synthetic oligonucleotide"
caccgggcagctggtgtg

SEQ ID NO: 1958 - DNA, 18 bp, Artificial Sequence
  source: /note="Description of Artificial Sequence: Synthetic oligonucleotide"
cccaccgggcagctggtg

SEQ ID NO: 1959 - DNA, 18 bp, Artificial Sequence
  source: /note="Description of Artificial Sequence: Synthetic oligonucleotide"
gccccaccgggcagctgg

SEQ ID NO: 1960 - DNA, 18 bp, Artificial Sequence
  source: /note="Description of Artificial Sequence: Synthetic oligonucleotide"
ctgccccaccgggcagct

SEQ ID NO: 1961 - DNA, 18 bp, Artificial Sequence
  source: /note="Description of Artificial Sequence: Synthetic oligonucleotide"
gtctgccccaccgggcag

SEQ ID NO: 1962 - DNA, 18 bp, Artificial Sequence
  source: /note="Description of Artificial Sequence: Synthetic oligonucleotide"
aggtctgccccaccgggc

SEQ ID NO: 1963 - DNA, 18 bp, Artificial Sequence
  source: /note="Description of Artificial Sequence: Synthetic oligonucleotide"
gcaggtctgccccaccgg

SEQ ID NO: 1964 - DNA, 18 bp, Artificial Sequence
  source: /note="Description of Artificial Sequence: Synthetic oligonucleotide"
cagcaggtctgccccacc

SEQ ID NO: 1965 - DNA, 18 bp, Artificial Sequence
  source: /note="Description of Artificial Sequence: Synthetic oligonucleotide"
ggcagcaggtctgcccca

SEQ ID NO: 1966 - DNA, 18 bp, Artificial Sequence
  source: /note="Description of Artificial Sequence: Synthetic oligonucleotide"
cgggcagcaggtctgccc

SEQ ID NO: 1967 - DNA, 18 bp, Artificial Sequence
  source: /note="Description of Artificial Sequence: Synthetic oligonucleotide"
ctcgggcagcaggtctgc

SEQ ID NO: 1968 - DNA, 18 bp, Artificial Sequence
  source: /note="Description of Artificial Sequence: Synthetic oligonucleotide"
ggctcgggcagcaggtct

SEQ ID NO: 1969 - DNA, 18 bp, Artificial Sequence
  source: /note="Description of Artificial Sequence: Synthetic oligonucleotide"
caggctcgggcagcaggt

SEQ ID NO: 1970 - DNA, 18 bp, Artificial Sequence
  source: /note="Description of Artificial Sequence: Synthetic oligonucleotide"
cccaggctcgggcagcag

SEQ ID NO: 1971 - DNA, 18 bp, Artificial Sequence
  source: /note="Description of Artificial Sequence: Synthetic oligonucleotide"
cacccaggctcgggcagc

SEQ ID NO: 1972 - DNA, 18 bp, Artificial Sequence
  source: /note="Description of Artificial Sequence: Synthetic oligonucleotide"
cccacccaggctcgggca

SEQ ID NO: 1973 - DNA, 18 bp, Artificial Sequence
  source: /note="Description of Artificial Sequence: Synthetic oligonucleotide"
ctcccacccaggctcggg

SEQ ID NO: 1974 - DNA, 18 bp, Artificial Sequence
  source: /note="Description of Artificial Sequence: Synthetic oligonucleotide"
agctcccacccaggctcg

SEQ ID NO: 1975 - DNA, 18 bp, Artificial Sequence
  source: /note="Description of Artificial Sequence: Synthetic oligonucleotide"
ccagctcccacccaggct

SEQ ID NO: 1976 - DNA, 18 bp, Artificial Sequence
  source: /note="Description of Artificial Sequence: Synthetic oligonucleotide"
gcccagctcccacccagg

SEQ ID NO: 1977 - DNA, 18 bp, Artificial Sequence
  source: /note="Description of Artificial Sequence: Synthetic oligonucleotide"
aggcccagctcccaccca

SEQ ID NO: 1978 - DNA, 18 bp, Artificial Sequence
  source: /note="Description of Artificial Sequence: Synthetic oligonucleotide"
gcaggcccagctcccacc

SEQ ID NO: 1979 - DNA, 18 bp, Artificial Sequence
  source: /note="Description of Artificial Sequence: Synthetic oligonucleotide"
cagcaggcccagctccca

SEQ ID NO: 1980 - DNA, 18 bp, Artificial Sequence
  source: /note="Description of Artificial Sequence: Synthetic oligonucleotide"
ggcagcaggcccagctcc

SEQ ID NO: 1981 - DNA, 18 bp, Artificial Sequence
  source: /note="Description of Artificial Sequence: Synthetic oligonucleotide"
ctggcagcaggcccagct

SEQ ID NO: 1982 - DNA, 18 bp, Artificial Sequence
  source: /note="Description of Artificial Sequence: Synthetic oligonucleotide"
aactggcagcaggcccag

SEQ ID NO: 1983 - DNA, 18 bp, Artificial Sequence
  source: /note="Description of Artificial Sequence: Synthetic oligonucleotide"
gcaactggcagcaggccc

SEQ ID NO: 1984 - DNA, 18 bp, Artificial Sequence
  source: /note="Description of Artificial Sequence: Synthetic oligonucleotide"
gggcaactggcagcaggc

SEQ ID NO: 1985 - DNA, 18 bp, Artificial Sequence
  source: /note="Description of Artificial Sequence: Synthetic oligonucleotide"
tggggcaactggcagcag

SEQ ID NO: 1986 - DNA, 18 bp, Artificial Sequence
  source: /note="Description of Artificial Sequence: Synthetic oligonucleotide"
catggggcaactggcagc

SEQ ID NO: 1987 - DNA, 18 bp, Artificial Sequence
  source: /note="Description of Artificial Sequence: Synthetic oligonucleotide"
cacatggggcaactggca

SEQ ID NO: 1988 - DNA, 18 bp, Artificial Sequence
  source: /note="Description of Artificial Sequence: Synthetic oligonucleotide"
ctcacatggggcaactgg

SEQ ID NO: 1989 - DNA, 18 bp, Artificial Sequence
  source: /note="Description of Artificial Sequence: Synthetic oligonucleotide"
cactcacatggggcaact

SEQ ID NO: 1990 - DNA, 18 bp, Artificial Sequence
  source: /note="Description of Artificial Sequence: Synthetic oligonucleotide"
ggcactcacatggggcaa

SEQ ID NO: 1991 - DNA, 18 bp, Artificial Sequence
  source: /note="Description of Artificial Sequence: Synthetic oligonucleotide"
gaggcactcacatggggc

SEQ ID NO: 1992 - DNA, 18 bp, Artificial Sequence
  source: /note="Description of Artificial Sequence: Synthetic oligonucleotide"
gggaggcactcacatggg

SEQ ID NO: 1993 - DNA, 18 bp, Artificial Sequence
  source: /note="Description of Artificial Sequence: Synthetic oligonucleotide"
cagggaggcactcacatg

SEQ ID NO: 1994 - DNA, 18 bp, Artificial Sequence
  source: /note="Description of Artificial Sequence: Synthetic oligonucleotide"
ggcagggaggcactcaca

SEQ ID NO: 1995 - DNA, 18 bp, Artificial Sequence
  source: /note="Description of Artificial Sequence: Synthetic oligonucleotide"
caggcagggaggcactca

SEQ ID NO: 1996 - DNA, 18 bp, Artificial Sequence
  source: /note="Description of Artificial Sequence: Synthetic oligonucleotide"
ggcaggcagggaggcact

SEQ ID NO: 1997 - DNA, 18 bp, Artificial Sequence
  source: /note="Description of Artificial Sequence: Synthetic oligonucleotide"
ggggcaggcagggaggca

SEQ ID NO: 1998 - DNA, 18 bp, Artificial Sequence
  source: /note="Description of Artificial Sequence: Synthetic oligonucleotide"
caggggcaggcagggagg

SEQ ID NO: 1999 - DNA, 18 bp, Artificial Sequence
  source: /note="Description of Artificial Sequence: Synthetic oligonucleotide"
tccaggggcaggcaggga

SEQ ID NO: 2000 - DNA, 18 bp, Artificial Sequence
  source: /note="Description of Artificial Sequence: Synthetic oligonucleotide"
tatccaggggcaggcagg

SEQ ID NO: 2001 - DNA, 18 bp, Artificial Sequence
  source: /note="Description of Artificial Sequence: Synthetic oligonucleotide"
cctatccaggggcaggca

SEQ ID NO: 2002 - DNA, 18 bp, Artificial Sequence
  source: /note="Description of Artificial Sequence: Synthetic oligonucleotide"
cccctatccaggggcagg

SEQ ID NO: 2003 - DNA, 18 bp, Artificial Sequence
  source: /note="Description of Artificial Sequence: Synthetic oligonucleotide"
ctcccctatccaggggca

SEQ ID NO: 2004 - DNA, 18 bp, Artificial Sequence
  source: /note="Description of Artificial Sequence: Synthetic oligonucleotide"
agctcccctatccagggg

SEQ ID NO: 2005 - DNA, 18 bp, Artificial Sequence
  source: /note="Description of Artificial Sequence: Synthetic oligonucleotide"
ttagctcccctatccagg

SEQ ID NO: 2006 - DNA, 18 bp, Artificial Sequence
  source: /note="Description of Artificial Sequence: Synthetic oligonucleotide"
gcttagctcccctatcca

SEQ ID NO: 2007 - DNA, 18 bp, Artificial Sequence
  source: /note="Description of Artificial Sequence: Synthetic oligonucleotide"
gggcttagctcccctatc

SEQ ID NO: 2008 - DNA, 18 bp, Artificial Sequence
  source: /note="Description of Artificial Sequence: Synthetic oligonucleotide"
ctgggcttagctccccta

SEQ ID NO: 2009 - DNA, 18 bp, Artificial Sequence
  source: /note="Description of Artificial Sequence: Synthetic oligonucleotide"
cactgggcttagctcccc

SEQ ID NO: 2010 - DNA, 18 bp, Artificial Sequence
  source: /note="Description of Artificial Sequence: Synthetic oligonucleotide"
ctcactgggcttagctcc

SEQ ID NO: 2011 - DNA, 18 bp, Artificial Sequence
  source: /note="Description of Artificial Sequence: Synthetic oligonucleotide"
ccctcactgggcttagct

SEQ ID NO: 2012 - DNA, 18 bp, Artificial Sequence
  source: /note="Description of Artificial Sequence: Synthetic oligonucleotide"
gttcctgtcccctcactg

SEQ ID NO: 2013 - DNA, 18 bp, Artificial Sequence
  source: /note="Description of Artificial Sequence: Synthetic oligonucleotide"
atgttcctgtcccctcac

SEQ ID NO: 2014 - DNA, 18 bp, Artificial Sequence
  source: /note="Description of Artificial Sequence: Synthetic oligonucleotide"
ttatgttcctgtcccctc

SEQ ID NO: 2015 - DNA, 18 bp, Artificial Sequence
  source: /note="Description of Artificial Sequence: Synthetic oligonucleotide"
cattatgttcctgtcccc

SEQ ID NO: 2016 - DNA, 18 bp, Artificial Sequence
  source: /note="Description of Artificial Sequence: Synthetic oligonucleotide"
ggcattatgttcctgtcc

SEQ ID NO: 2017 - DNA, 18 bp, Artificial Sequence
  source: /note="Description of Artificial Sequence: Synthetic oligonucleotide"
atggcattatgttcctgt

SEQ ID NO: 2018 - DNA, 18 bp, Artificial Sequence
  source: /note="Description of Artificial Sequence: Synthetic oligonucleotide"
gaatggcattatgttcct

SEQ ID NO: 2019 - DNA, 18 bp, Artificial Sequence
  source: /note="Description of Artificial Sequence: Synthetic oligonucleotide"
cagaatggcattatgttc

SEQ ID NO: 2020 - DNA, 18 bp, Artificial Sequence
  source: /note="Description of Artificial Sequence: Synthetic oligonucleotide"
cacagaatggcattatgt

SEQ ID NO: 2021 - DNA, 18 bp, Artificial Sequence
  source: /note="Description of Artificial Sequence: Synthetic oligonucleotide"
agcacagaatggcattat

SEQ ID NO: 2022 - DNA, 18 bp, Artificial Sequence
  source: /note="Description of Artificial Sequence: Synthetic oligonucleotide"
ggagcacagaatggcatt

SEQ ID NO: 2023 - DNA, 18 bp, Artificial Sequence
  source: /note="Description of Artificial Sequence: Synthetic oligonucleotide"
agggagcacagaatggca

SEQ ID NO: 2024 - DNA, 18 bp, Artificial Sequence
  source: /note="Description of Artificial Sequence: Synthetic oligonucleotide"
gaagggagcacagaatgg

SEQ ID NO: 2025 - DNA, 18 bp, Artificial Sequence
  source: /note="Description of Artificial Sequence: Synthetic oligonucleotide"
gggaagggagcacagaat

SEQ ID NO: 2026 - DNA, 18 bp, Artificial Sequence
  source: /note="Description of Artificial Sequence: Synthetic oligonucleotide"
cggggaagggagcacaga

SEQ ID NO: 2027 - DNA, 18 bp, Artificial Sequence
  source: /note="Description of Artificial Sequence: Synthetic oligonucleotide"
ggcggggaagggagcaca

SEQ ID NO: 2028 - DNA, 18 bp, Artificial Sequence
  source: /note="Description of Artificial Sequence: Synthetic oligonucleotide"
ctggcggggaagggagca

SEQ ID NO: 2029 - DNA, 18 bp, Artificial Sequence
  source: /note="Description of Artificial Sequence: Synthetic oligonucleotide"
gcctggcggggaagggag

SEQ ID NO: 2030 - DNA, 18 bp, Artificial Sequence
  source: /note="Description of Artificial Sequence: Synthetic oligonucleotide"
cagcctggcggggaaggg

SEQ ID NO: 2031 - DNA, 18 bp, Artificial Sequence
  source: /note="Description of Artificial Sequence: Synthetic oligonucleotide"
cacagcctggcggggaag

SEQ ID NO: 2032 - DNA, 18 bp, Artificial Sequence
  source: /note="Description of Artificial Sequence: Synthetic oligonucleotide"
cacacagcctggcgggga

SEQ ID NO: 2033 - DNA, 18 bp, Artificial Sequence
  source: /note="Description of Artificial Sequence: Synthetic oligonucleotide"
agcacacagcctggcggg

SEQ ID NO: 2034 - DNA, 18 bp, Artificial Sequence
  source: /note="Description of Artificial Sequence: Synthetic oligonucleotide"
gcagcacacagcctggcg

SEQ ID NO: 2035 - DNA, 18 bp, Artificial Sequence
  source: /note="Description of Artificial Sequence: Synthetic oligonucleotide"
tcgcagcacacagcctgg

SEQ ID NO: 2036 - DNA, 18 bp, Artificial Sequence
  source: /note="Description of Artificial Sequence: Synthetic oligonucleotide"
cctcgcagcacacagcct

SEQ ID NO: 2037 - DNA, 18 bp, Artificial Sequence
  source: /note="Description of Artificial Sequence: Synthetic oligonucleotide"
atcctcgcagcacacagc

SEQ ID NO: 2038 - DNA, 18 bp, Artificial Sequence
  source: /note="Description of Artificial Sequence: Synthetic oligonucleotide"
cgatcctcgcagcacaca

SEQ ID NO: 2039 - DNA, 18 bp, Artificial Sequence
  source: /note="Description of Artificial Sequence: Synthetic oligonucleotide"
ggcgatcctcgcagcaca

SEQ ID NO: 2040 - DNA, 18 bp, Artificial Sequence
  source: /note="Description of Artificial Sequence: Synthetic oligonucleotide"
ctggcgatcctcgcagca

SEQ ID NO: 2041 - DNA, 18 bp, Artificial Sequence
  source: /note="Description of Artificial Sequence: Synthetic oligonucleotide"
tgctggcgatcctcgcag

SEQ ID NO: 2042 - DNA, 18 bp, Artificial Sequence
  source: /note="Description of Artificial Sequence: Synthetic oligonucleotide"
agtgctggcgatcctcgc

SEQ ID NO: 2043 - DNA, 18 bp, Artificial Sequence
  source: /note="Description of Artificial Sequence: Synthetic oligonucleotide"
gcagtgctggcgatcctc

SEQ ID NO: 2044 - DNA, 18 bp, Artificial Sequence
  source: /note="Description of Artificial Sequence: Synthetic oligonucleotide"
cagcagtgctggcgatcc

SEQ ID NO: 2045 - DNA, 18 bp, Artificial Sequence
  source: /note="Description of Artificial Sequence: Synthetic oligonucleotide"
ggcagcagtgctggcgat

SEQ ID NO: 2046 - DNA, 18 bp, Artificial Sequence
  source: /note="Description of Artificial Sequence: Synthetic oligonucleotide"
cgggcagcagtgctggcg

SEQ ID NO: 2047 - DNA, 18 bp, Artificial Sequence
  source: /note="Description of Artificial Sequence: Synthetic oligonucleotide"
gccgggcagcagtgctgg

SEQ ID NO: 2048 - DNA, 18 bp, Artificial Sequence
  source: /note="Description of Artificial Sequence: Synthetic oligonucleotide"
cagccgggcagcagtgct

SEQ ID NO: 2049 - DNA, 18 bp, Artificial Sequence
  source: /note="Description of Artificial Sequence: Synthetic oligonucleotide"
gccagccgggcagcagtg

SEQ ID NO: 2050 - DNA, 18 bp, Artificial Sequence
  source: /note="Description of Artificial Sequence: Synthetic oligonucleotide"
tagccagccgggcagcag

SEQ ID NO: 2051 - DNA, 18 bp, Artificial Sequence
  source: /note="Description of Artificial Sequence: Synthetic oligonucleotide"
tgtagccagccgggcagc

SEQ ID NO: 2052 - DNA, 18 bp, Artificial Sequence
  source: /note="Description of Artificial Sequence: Synthetic oligonucleotide"
ggtgtagccagccgggca

SEQ ID NO: 2053 - DNA, 18 bp, Artificial Sequence
  source: /note="Description of Artificial Sequence: Synthetic oligonucleotide"
caggtgtagccagccggg

SEQ ID NO: 2054 - DNA, 18 bp, Artificial Sequence
  source: /note="Description of Artificial Sequence: Synthetic oligonucleotide"
tgcaggtgtagccagccg

SEQ ID NO: 2055 - DNA, 18 bp, Artificial Sequence
  source: /note="Description of Artificial Sequence: Synthetic oligonucleotide"
gttgcaggtgtagccagc

SEQ ID NO: 2056 - DNA, 18 bp, Artificial Sequence
  source: /note="Description of Artificial Sequence: Synthetic oligonucleotide"
acgttgcaggtgtagcca

SEQ ID NO: 2057 - DNA, 18 bp, Artificial Sequence
  source: /note="Description of Artificial Sequence: Synthetic oligonucleotide"
tcacgttgcaggtgtagc

SEQ ID NO: 2058 - DNA, 18 bp, Artificial Sequence
  source: /note="Description of Artificial Sequence: Synthetic oligonucleotide"
cttcacgttgcaggtgta

SEQ ID NO: 2059 - DNA, 18 bp, Artificial Sequence
  source: /note="Description of Artificial Sequence: Synthetic oligonucleotide"
gccttcacgttgcaggtg

SEQ ID NO: 2060 - DNA, 18 bp, Artificial Sequence
  source: /note="Description of Artificial Sequence: Synthetic oligonucleotide"
gagccttcacgttgcagg

SEQ ID NO: 2061 - DNA, 18 bp, Artificial Sequence
  source: /note="Description of Artificial Sequence: Synthetic oligonucleotide"
tcgagccttcacgttgca

SEQ ID NO: 2062 - DNA, 18 bp, Artificial Sequence
  source: /note="Description of Artificial Sequence: Synthetic oligonucleotide"
gatcgagccttcacgttg

SEQ ID NO: 2063 - DNA, 18 bp, Artificial Sequence
  source: /note="Description of Artificial Sequence: Synthetic oligonucleotide"
aggatcgagccttcacgt

SEQ ID NO: 2064 - DNA, 18 bp, Artificial Sequence
  source: /note="Description of Artificial Sequence: Synthetic oligonucleotide"
gcaggatcgagccttcac

SEQ ID NO: 2065 - DNA, 18 bp, Artificial Sequence
  source: /note="Description of Artificial Sequence: Synthetic oligonucleotide"
tcgcaggatcgagccttc

SEQ ID NO: 2066 - DNA, 18 bp, Artificial Sequence
  source: /note="Description of Artificial Sequence: Synthetic oligonucleotide"
tctcgcaggatcgagcct

SEQ ID NO: 2067 - DNA, 18 bp, Artificial Sequence
  source: /note="Description of Artificial Sequence: Synthetic oligonucleotide"
cttctcgcaggatcgagc

SEQ ID NO: 2068 - DNA, 18 bp, Artificial Sequence
  source: /note="Description of Artificial Sequence: Synthetic oligonucleotide"
tccttctcgcaggatcga

SEQ ID NO: 2069 - DNA, 18 bp, Artificial Sequence
  source: /note="Description of Artificial Sequence: Synthetic oligonucleotide"
cttccttctcgcaggatc

SEQ ID NO: 2070 - DNA, 18 bp, Artificial Sequence
  source: /note="Description of Artificial Sequence: Synthetic oligonucleotide"
cacttccttctcgcagga

SEQ ID NO: 2071 - DNA, 18 bp, Artificial Sequence
  source: /note="Description of Artificial Sequence: Synthetic oligonucleotide"
accacttccttctcgcag

SEQ ID NO: 2072 - DNA, 18 bp, Artificial Sequence
  source: /note="Description of Artificial Sequence: Synthetic oligonucleotide"
agaccacttccttctcgc

SEQ ID NO: 2073 - DNA, 18 bp, Artificial Sequence
  source: /note="Description of Artificial Sequence: Synthetic oligonucleotide"
agagaccacttccttctc

SEQ ID NO: 2074 - DNA, 18 bp, Artificial Sequence
  source: /note="Description of Artificial Sequence: Synthetic oligonucleotide"
gcagagaccacttccttc

SEQ ID NO: 2075 - DNA, 18 bp, Artificial Sequence
  source: /note="Description of Artificial Sequence: Synthetic oligonucleotide"
gggcagagaccacttcct

SEQ ID NO: 2076 - DNA, 18 bp, Artificial Sequence
  source: /note="Description of Artificial Sequence: Synthetic oligonucleotide"
ctgggcagagaccacttc

SEQ ID NO: 2077 - DNA, 18 bp, Artificial Sequence
  source: /note="Description of Artificial Sequence: Synthetic oligonucleotide"
ggctgggcagagaccact

SEQ ID NO: 2078 - DNA, 18 bp, Artificial Sequence
  source: /note="Description of Artificial Sequence: Synthetic oligonucleotide"
caggctgggcagagacca

SEQ ID NO: 2079 - DNA, 18 bp, Artificial Sequence
  source: /note="Description of Artificial Sequence: Synthetic oligonucleotide"
ggcaggctgggcagagac

SEQ ID NO: 2080 - DNA, 18 bp, Artificial Sequence
  source: /note="Description of Artificial Sequence: Synthetic oligonucleotide"
gtggcaggctgggcagag

SEQ ID NO: 2081 - DNA, 18 bp, Artificial Sequence
  source: /note="Description of Artificial Sequence: Synthetic oligonucleotide"
aggtggcaggctgggcag

SEQ ID NO: 2082 - DNA, 18 bp, Artificial Sequence
  source: /note="Description of Artificial Sequence: Synthetic oligonucleotide"
gaaggtggcaggctgggc

SEQ ID NO: 2083 - DNA, 18 bp, Artificial Sequence
  source: /note="Description of Artificial Sequence: Synthetic oligonucleotide"
aggaaggtggcaggctgg

SEQ ID NO: 2084 - DNA, 18 bp, Artificial Sequence
  source: /note="Description of Artificial Sequence: Synthetic oligonucleotide"
ccaggaaggtggcaggct

SEQ ID NO: 2085 - DNA, 18 bp, Artificial Sequence
  source: /note="Description of Artificial Sequence: Synthetic oligonucleotide"
ggccaggaaggtggcagg

SEQ ID NO: 2086 - DNA, 18 bp, Artificial Sequence
  source: /note="Description of Artificial Sequence: Synthetic oligonucleotide"
cgggccaggaaggtggca

SEQ ID NO: 2087 - DNA, 18 bp, Artificial Sequence
  source: /note="Description of Artificial Sequence: Synthetic oligonucleotide"
tacgggccaggaaggtgg

SEQ ID NO: 2088 - DNA, 18 bp, Artificial Sequence
  source: /note="Description of Artificial Sequence: Synthetic oligonucleotide"
gctacgggccaggaaggt

SEQ ID NO: 2089 - DNA, 18 bp, Artificial Sequence
  source: /note="Description of Artificial Sequence: Synthetic oligonucleotide"
gggctacgggccaggaag

SEQ ID NO: 2090 - DNA, 18 bp, Artificial Sequence
  source: /note="Description of Artificial Sequence: Synthetic oligonucleotide"
gagggctacgggccagga

SEQ ID NO: 2091 - DNA, 18 bp, Artificial Sequence
  source: /note="Description of Artificial Sequence: Synthetic oligonucleotide"
gtgagggctacgggccag

SEQ ID NO: 2092 - DNA, 18 bp, Artificial Sequence
  source: /note="Description of Artificial Sequence: Synthetic oligonucleotide"
acgtgagggctacgggcc

SEQ ID NO: 2093 - DNA, 18 bp, Artificial Sequence
  source: /note="Description of Artificial Sequence: Synthetic oligonucleotide"
ccacgtgagggctacggg

SEQ ID NO: 2094 - DNA, 18 bp, Artificial Sequence
  source: /note="Description of Artificial Sequence: Synthetic oligonucleotide"
acccacgtgagggctacg

SEQ ID NO: 2095 - DNA, 18 bp, Artificial Sequence
  source: /note="Description of Artificial Sequence: Synthetic oligonucleotide"
acacccacgtgagggcta

SEQ ID NO: 2096 - DNA, 18 bp, Artificial Sequence
  source: /note="Description of Artificial Sequence: Synthetic oligonucleotide"
tcacacccacgtgagggc

SEQ ID NO: 2097 - DNA, 18 bp, Artificial Sequence
  source: /note="Description of Artificial Sequence: Synthetic oligonucleotide"
cttcacacccacgtgagg

SEQ ID NO: 2098 - DNA, 18 bp, Artificial Sequence
  source: /note="Description of Artificial Sequence: Synthetic oligonucleotide"
tccttcacacccacgtga

SEQ ID NO: 2099 - DNA, 18 bp, Artificial Sequence
  source: /note="Description of Artificial Sequence: Synthetic oligonucleotide"
cgtccttcacacccacgt

SEQ ID NO: 2100 - DNA, 18 bp, Artificial Sequence
  source: /note="Description of Artificial Sequence: Synthetic oligonucleotide"
cacgtccttcacacccac

SEQ ID NO: 2101 - DNA, 18 bp, Artificial Sequence
  source: /note="Description of Artificial Sequence: Synthetic oligonucleotide"
tccacgtccttcacaccc

SEQ ID NO: 2102 - DNA, 18 bp, Artificial Sequence
  source: /note="Description of Artificial Sequence: Synthetic oligonucleotide"
actccacgtccttcacac

SEQ ID NO: 2103 - DNA, 18 bp, Artificial Sequence
  source: /note="Description of Artificial Sequence: Synthetic oligonucleotide"
acactccacgtccttcac

SEQ ID NO: 2104 - DNA, 18 bp, Artificial Sequence
  source: /note="Description of Artificial Sequence: Synthetic oligonucleotide"
ccacactccacgtccttc

SEQ ID NO: 2105 - DNA, 18 bp, Artificial Sequence
  source: /note="Description of Artificial Sequence: Synthetic oligonucleotide"
ccccacactccacgtcct

SEQ ID NO: 2106 - DNA, 18 bp, Artificial Sequence
  source: /note="Description of Artificial Sequence: Synthetic oligonucleotide"
ttccccacactccacgtc

SEQ ID NO: 2107 - DNA, 18 bp, Artificial Sequence
  source: /note="Description of Artificial Sequence: Synthetic oligonucleotide"
ccttccccacactccacg

SEQ ID NO: 2108 - DNA, 18 bp, Artificial Sequence
  source: /note="Description of Artificial Sequence: Synthetic oligonucleotide"
gtccttccccacactcca

SEQ ID NO: 2109 - DNA, 18 bp, Artificial Sequence
  source: /note="Description of Artificial Sequence: Synthetic oligonucleotide"
gtgtccttccccacactc

SEQ ID NO: 2110 - DNA, 18 bp, Artificial Sequence
  source: /note="Description of Artificial Sequence: Synthetic oligonucleotide"
aagtgtccttccccacac

SEQ ID NO: 2111 - DNA, 18 bp, Artificial Sequence
  source: /note="Description of Artificial Sequence: Synthetic oligonucleotide"
agaagtgtccttccccac

SEQ ID NO: 2112 - DNA, 18 bp, Artificial Sequence
  source: /note="Description of Artificial Sequence: Synthetic oligonucleotide"
gcagaagtgtccttcccc

SEQ ID NO: 2113 - DNA, 18 bp, Artificial Sequence
  source: /note="Description of Artificial Sequence: Synthetic oligonucleotide"
tggcagaagtgtccttcc

SEQ ID NO: 2114 - DNA, 18 bp, Artificial Sequence
  source: /note="Description of Artificial Sequence: Synthetic oligonucleotide"
catggcagaagtgtcctt

SEQ ID NO: 2115 - DNA, 18 bp, Artificial Sequence
  source: /note="Description of Artificial Sequence: Synthetic oligonucleotide"
atcatggcagaagtgtcc

SEQ ID NO: 2116 - DNA, 18 bp, Artificial Sequence
  source: /note="Description of Artificial Sequence: Synthetic oligonucleotide"
ttatcatggcagaagtgt

SEQ ID NO: 2117 - DNA, 18 bp, Artificial Sequence
  source: /note="Description of Artificial Sequence: Synthetic oligonucleotide"
ggttatcatggcagaagt

SEQ ID NO: 2118 - DNA, 18 bp, Artificial Sequence
  source: /note="Description of Artificial Sequence: Synthetic oligonucleotide"
ctggttatcatggcagaa

SEQ ID NO: 2119 - DNA, 18 bp, Artificial Sequence
  source: /note="Description of Artificial Sequence: Synthetic oligonucleotide"
gtctggttatcatggcag

SEQ ID NO: 2120 - DNA, 18 bp, Artificial Sequence
  source: /note="Description of Artificial Sequence: Synthetic oligonucleotide"
aggtctggttatcatggc

SEQ ID NO: 2121 - DNA, 18 bp, Artificial Sequence
  source: /note="Description of Artificial Sequence: Synthetic oligonucleotide"
gcaggtctggttatcatg

SEQ ID NO: 2122 - DNA, 18 bp, Artificial Sequence
  source: /note="Description of Artificial Sequence: Synthetic oligonucleotide"
cagcaggtctggttatca

SEQ ID NO: 2123 - DNA, 18 bp, Artificial Sequence
  source: /note="Description of Artificial Sequence: Synthetic oligonucleotide"
ggcagcaggtctggttat

SEQ ID NO: 2124 - DNA, 18 bp, Artificial Sequence
  source: /note="Description of Artificial Sequence: Synthetic oligonucleotide"
tcggcagcaggtctggtt

SEQ ID NO: 2125 - DNA, 18 bp, Artificial Sequence
  source: /note="Description of Artificial Sequence: Synthetic oligonucleotide"
tctcggcagcaggtctgg

SEQ ID NO: 2126 - DNA, 18 bp, Artificial Sequence
  source: /note="Description of Artificial Sequence: Synthetic oligonucleotide"
tgtctcggcagcaggtct

SEQ ID NO: 2127 - DNA, 18 bp, Artificial Sequence
  source: /note="Description of Artificial Sequence: Synthetic oligonucleotide"
gttgtctcggcagcaggt

SEQ ID NO: 2128 - DNA, 18 bp, Artificial Sequence
  source: /note="Description of Artificial Sequence: Synthetic oligonucleotide"
cggttgtctcggcagcag

SEQ ID NO: 2129 - DNA, 18 bp, Artificial Sequence
  source: /note="Description of Artificial Sequence: Synthetic oligonucleotide"
gtcggttgtctcggcagc

SEQ ID NO: 2130 - DNA, 18 bp, Artificial Sequence
  source: /note="Description of Artificial Sequence: Synthetic oligonucleotide"
ctgtcggttgtctcggca

SEQ ID NO: 2131 - DNA, 18 bp, Artificial Sequence
  source: /note="Description of Artificial Sequence: Synthetic oligonucleotide"
ccctgtcggttgtctcgg

SEQ ID NO: 2132 - DNA, 18 bp, Artificial Sequence
  source: /note="Description of Artificial Sequence: Synthetic oligonucleotide"
agccctgtcggttgtctc

SEQ ID NO: 2133 - DNA, 18 bp, Artificial Sequence
  source: /note="Description of Artificial Sequence: Synthetic oligonucleotide"
ccagccctgtcggttgtc

SEQ ID NO: 2134 - DNA, 18 bp, Artificial Sequence
  source: /note="Description of Artificial Sequence: Synthetic oligonucleotide"
gcccagccctgtcggttg

SEQ ID NO: 2135 - DNA, 18 bp, Artificial Sequence
  source: /note="Description of Artificial Sequence: Synthetic oligonucleotide"
aggcccagccctgtcggt

SEQ ID NO: 2136 - DNA, 18 bp, Artificial Sequence
  source: /note="Description of Artificial Sequence: Synthetic oligonucleotide"
gcaggcccagccctgtcg

SEQ ID NO: 2137 - DNA, 18 bp, Artificial Sequence
  source: /note="Description of Artificial Sequence: Synthetic oligonucleotide"
cagcaggcccagccctgt

SEQ ID NO: 2138 - DNA, 18 bp, Artificial Sequence
  source: /note="Description of Artificial Sequence: Synthetic oligonucleotide"
gacagcaggcccagccct

SEQ ID NO: 2139 - DNA, 18 bp, Artificial Sequence
  source: /note="Description of Artificial Sequence: Synthetic oligonucleotide"
gggacagcaggcccagcc

SEQ ID NO: 2140 - DNA, 18 bp, Artificial Sequence
  source: /note="Description of Artificial Sequence: Synthetic oligonucleotide"
tagggacagcaggcccag

SEQ ID NO: 2141 - DNA, 18 bp, Artificial Sequence
  source: /note="Description of Artificial Sequence: Synthetic oligonucleotide"
ggtagggacagcaggccc

SEQ ID NO: 2142 - DNA, 18 bp, Artificial Sequence
  source: /note="Description of Artificial Sequence: Synthetic oligonucleotide"
gcggtagggacagcaggc

SEQ ID NO: 2143 - DNA, 18 bp, Artificial Sequence
  source: /note="Description of Artificial Sequence: Synthetic oligonucleotide"
tggcggtagggacagcag

SEQ ID NO: 2144 - DNA, 18 bp, Artificial Sequence
  source: /note="Description of Artificial Sequence: Synthetic oligonucleotide"
atgggggttggcactgac

SEQ ID NO: 2145 - DNA, 18 bp, Artificial Sequence
  source: /note="Description of Artificial Sequence: Synthetic oligonucleotide"
ggatgggggttggcactg

SEQ ID NO: 2146 - DNA, 18 bp, Artificial Sequence
  source: /note="Description of Artificial Sequence: Synthetic oligonucleotide"
caggatgggggttggcac

SEQ ID NO: 2147 - DNA, 18 bp, Artificial Sequence
  source: /note="Description of Artificial Sequence: Synthetic oligonucleotide"
cccaggatgggggttggc

SEQ ID NO: 2148 - DNA, 18 bp, Artificial Sequence
  source: /note="Description of Artificial Sequence: Synthetic oligonucleotide"
gccccaggatgggggttg

SEQ ID NO: 2149 - DNA, 18 bp, Artificial Sequence
  source: /note="Description of Artificial Sequence: Synthetic oligonucleotide"
cagccccaggatgggggt

SEQ ID NO: 2150 - DNA, 18 bp, Artificial Sequence
  source: /note="Description of Artificial Sequence: Synthetic oligonucleotide"
cccagccccaggatgggg

SEQ ID NO: 2151 - DNA, 18 bp, Artificial Sequence
  source: /note="Description of Artificial Sequence: Synthetic oligonucleotide"
tacccagccccaggatgg

SEQ ID NO: 2152 - DNA, 18 bp, Artificial Sequence
  source: /note="Description of Artificial Sequence: Synthetic oligonucleotide"
catacccagccccaggat

SEQ ID NO: 2153 - DNA, 18 bp, Artificial Sequence
  source: /note="Description of Artificial Sequence: Synthetic oligonucleotide"
gccatacccagccccagg

SEQ ID NO: 2154 - DNA, 18 bp, Artificial Sequence
  source: /note="Description of Artificial Sequence: Synthetic oligonucleotide"
tggccatacccagcccca

SEQ ID NO: 2155 - DNA, 18 bp, Artificial Sequence
  source: /note="Description of Artificial Sequence: Synthetic oligonucleotide"
cctggccatacccagccc

SEQ ID NO: 2156 - DNA, 18 bp, Artificial Sequence
  source: /note="Description of Artificial Sequence: Synthetic oligonucleotide"
tccctggccatacccagc

SEQ ID NO: 2157 - DNA, 18 bp, Artificial Sequence
  source: /note="Description of Artificial Sequence: Synthetic oligonucleotide"
ggtccctggccataccca

SEQ ID NO: 2158 - DNA, 18 bp, Artificial Sequence
  source: /note="Description of Artificial Sequence: Synthetic oligonucleotide"
ctggtccctggccatacc

SEQ ID NO: 2159 - DNA, 18 bp, Artificial Sequence
  source: /note="Description of Artificial Sequence: Synthetic oligonucleotide"
acctggtccctggccata

SEQ ID NO: 2160 - DNA, 18 bp, Artificial Sequence
  source: /note="Description of Artificial Sequence: Synthetic oligonucleotide"
ggacctggtccctggcca

SEQ ID NO: 2161 - DNA, 18 bp, Artificial Sequence
  source: /note="Description of Artificial Sequence: Synthetic oligonucleotide"
gaggtgggacctggtccc

SEQ ID NO: 2162 - DNA, 18 bp, Artificial Sequence
  source: /note="Description of Artificial Sequence: Synthetic oligonucleotide"
acgaggtgggacctggtc

SEQ ID NO: 2163 - DNA, 18 bp, Artificial Sequence
  source: /note="Description of Artificial Sequence: Synthetic oligonucleotide"
ggacgaggtgggacctgg

SEQ ID NO: 2164 - DNA, 18 bp, Artificial Sequence
  source: /note="Description of Artificial Sequence: Synthetic oligonucleotide"
ttggacgaggtgggacct

SEQ ID NO: 2165 - DNA, 18 bp, Artificial Sequence
  source: /note="Description of Artificial Sequence: Synthetic oligonucleotide"
ggttggacgaggtgggac

SEQ ID NO: 2166 - DNA, 18 bp, Artificial Sequence
  source: /note="Description of Artificial Sequence: Synthetic oligonucleotide"
agggttggacgaggtggg

SEQ ID NO: 2167 - DNA, 18 bp, Artificial Sequence
  source: /note="Description of Artificial Sequence: Synthetic oligonucleotide"
agagggttggacgaggtg

SEQ ID NO: 2168 - DNA, 18 bp, Artificial Sequence
  source: /note="Description of Artificial Sequence: Synthetic oligonucleotide"
cgagagggttggacgagg

SEQ ID NO: 2169 - DNA, 18 bp, Artificial Sequence
  source: /note="Description of Artificial Sequence: Synthetic oligonucleotide"
ggcgagagggttggacga

SEQ ID NO: 2170 - DNA, 18 bp, Artificial Sequence
  source: /note="Description of Artificial Sequence: Synthetic oligonucleotide"
ggggcgagagggttggac

SEQ ID NO: 2171 - DNA, 18 bp, Artificial Sequence
  source: /note="Description of Artificial Sequence: Synthetic oligonucleotide"
ggggggcgagagggttgg

SEQ ID NO: 2172 - DNA, 18 bp, Artificial Sequence
  source: /note="Description of Artificial Sequence: Synthetic oligonucleotide"
gaggggggcgagagggtt

SEQ ID NO: 2173 - DNA, 18 bp, Artificial Sequence
  source: /note="Description of Artificial Sequence: Synthetic oligonucleotide"
cagaggggggcgagaggg

SEQ ID NO: 2174 - DNA, 18 bp, Artificial Sequence
  source: /note="Description of Artificial Sequence: Synthetic oligonucleotide"
gtcagaggggggcgagag

SEQ ID NO: 2175 - DNA, 18 bp, Artificial Sequence
  source: /note="Description of Artificial Sequence: Synthetic oligonucleotide"
tggtcagaggggggcgag

SEQ ID NO: 2176 - DNA, 18 bp, Artificial Sequence
  source: /note="Description of Artificial Sequence: Synthetic oligonucleotide"
gatggtcagaggggggcg

SEQ ID NO: 2177 - DNA, 18 bp, Artificial Sequence
  source: /note="Description of Artificial Sequence: Synthetic oligonucleotide"
tggatggtcagagggggg

SEQ ID NO: 2178 - DNA, 18 bp, Artificial Sequence
  source: /note="Description of Artificial Sequence: Synthetic oligonucleotide"
atcagcacaacagacgcc

SEQ ID NO: 2179 - DNA, 18 bp, Artificial Sequence
  source: /note="Description of Artificial Sequence: Synthetic oligonucleotide"
cgatcagcacaacagacg

SEQ ID NO: 2180 - DNA, 18 bp, Artificial Sequence
  source: /note="Description of Artificial Sequence: Synthetic oligonucleotide"
gccgatcagcacaacaga

SEQ ID NO: 2181 - DNA, 18 bp, Artificial Sequence
  source: /note="Description of Artificial Sequence: Synthetic oligonucleotide"
gcgccgatcagcacaaca

SEQ ID NO: 2182 - DNA, 18 bp, Artificial Sequence
  source: /note="Description of Artificial Sequence: Synthetic oligonucleotide"
tggcgccgatcagcacaa

SEQ ID NO: 2183 - DNA, 18 bp, Artificial Sequence
  source: /note="Description of Artificial Sequence: Synthetic oligonucleotide"
agtggcgccgatcagcac

SEQ ID NO: 2184 - DNA, 18 bp, Artificial Sequence
  source: /note="Description of Artificial Sequence: Synthetic oligonucleotide"
gcagtggcgccgatcagc

SEQ ID NO: 2185 - DNA, 18 bp, Artificial Sequence
  source: /note="Description of Artificial Sequence: Synthetic oligonucleotide"
cagcagtggcgccgatca

SEQ ID NO: 2186 - DNA, 18 bp, Artificial Sequence
  source: /note="Description of Artificial Sequence: Synthetic oligonucleotide"
gacagcagtggcgccgat

SEQ ID NO: 2187 - DNA, 18 bp, Artificial Sequence
  source: /note="Description of Artificial Sequence: Synthetic oligonucleotide"
aggacagcagtggcgccg

SEQ ID NO: 2188 - DNA, 18 bp, Artificial Sequence
  source: /note="Description of Artificial Sequence: Synthetic oligonucleotide"
gcaggacagcagtggcgc

SEQ ID NO: 2189 - DNA, 18 bp, Artificial Sequence
  source: /note="Description of Artificial Sequence: Synthetic oligonucleotide"
cagcaggacagcagtggc

SEQ ID NO: 2190 - DNA, 18 bp, Artificial Sequence
  source: /note="Description of Artificial Sequence: Synthetic oligonucleotide"
gccagcaggacagcagtg

SEQ ID NO: 2191 - DNA, 18 bp, Artificial Sequence
  source: /note="Description of Artificial Sequence: Synthetic oligonucleotide"
aagccagcaggacagcag

SEQ ID NO: 2192 - DNA, 18 bp, Artificial Sequence
  source: /note="Description of Artificial Sequence: Synthetic oligonucleotide"
ggaagccagcaggacagc

SEQ ID NO: 2193 - DNA, 18 bp, Artificial Sequence
  source: /note="Description of Artificial Sequence: Synthetic oligonucleotide"
gcggaagccagcaggaca

SEQ ID NO: 2194 - DNA, 18 bp, Artificial Sequence
  source: /note="Description of Artificial Sequence: Synthetic oligonucleotide"
cagcggaagccagcagga

SEQ ID NO: 2195 - DNA, 18 bp, Artificial Sequence
  source: /note="Description of Artificial Sequence: Synthetic oligonucleotide"
cgcagcggaagccagcag

SEQ ID NO: 2196 - DNA, 18 bp, Artificial Sequence
  source: /note="Description of Artificial Sequence: Synthetic oligonucleotide"
tgcgcagcggaagccagc

SEQ ID NO: 2197 - DNA, 18 bp, Artificial Sequence
  source: /note="Description of Artificial Sequence: Synthetic oligonucleotide"
gctgcgcagcggaagcca

SEQ ID NO: 2198 - DNA, 18 bp, Artificial Sequence
  source: /note="Description of Artificial Sequence: Synthetic oligonucleotide"
tggctgcgcagcggaagc

SEQ ID NO: 2199 - DNA, 18 bp, Artificial Sequence
  source: /note="Description of Artificial Sequence: Synthetic oligonucleotide"
cctggctgcgcagcggaa

SEQ ID NO: 2200 - DNA, 18 bp, Artificial Sequence
  source: /note="Description of Artificial Sequence: Synthetic oligonucleotide"
cccctggctgcgcagcgg

SEQ ID NO: 2201 - DNA, 18 bp, Artificial Sequence
  source: /note="Description of Artificial Sequence: Synthetic oligonucleotide"
tacccctggctgcgcagc

SEQ ID NO: 2202 - DNA, 18 bp, Artificial Sequence
  source: /note="Description of Artificial Sequence: Synthetic oligonucleotide"
ggtacccctggctgcgca

SEQ ID NO: 2203 - DNA, 18 bp, Artificial Sequence
  source: /note="Description of Artificial Sequence: Synthetic oligonucleotide"
ttggtacccctggctgcg

SEQ ID NO: 2204 - DNA, 18 bp, Artificial Sequence
  source: /note="Description of Artificial Sequence: Synthetic oligonucleotide"
acttggtacccctggctg

SEQ ID NO: 2205 - DNA, 18 bp, Artificial Sequence
  source: /note="Description of Artificial Sequence: Synthetic oligonucleotide"
acacttggtacccctggc

SEQ ID NO: 2206 - DNA, 18 bp, Artificial Sequence
  source: /note="Description of Artificial Sequence: Synthetic oligonucleotide"
aaacacttggtacccctg

SEQ ID NO: 2207 - DNA, 18 bp, Artificial Sequence
  source: /note="Description of Artificial Sequence: Synthetic oligonucleotide"
gcaaacacttggtacccc

SEQ ID NO: 2208 - DNA, 18 bp, Artificial Sequence
  source: /note="Description of Artificial Sequence: Synthetic oligonucleotide"
gcgcaaacacttggtacc

SEQ ID NO: 2209 - DNA, 18 bp, Artificial Sequence
  source: /note="Description of Artificial Sequence: Synthetic oligonucleotide"
ctgcgcaaacacttggta

SEQ ID NO: 2210 - DNA, 18 bp, Artificial Sequence
  source: /note="Description of Artificial Sequence: Synthetic oligonucleotide"
ccctgcgcaaacacttgg

SEQ ID NO: 2211 - DNA, 18 bp, Artificial Sequence
  source: /note="Description of Artificial Sequence: Synthetic oligonucleotide"
ctccctgcgcaaacactt

SEQ ID NO: 2212 - DNA, 18 bp, Artificial Sequence
  source: /note="Description of Artificial Sequence: Synthetic oligonucleotide"
gcctccctgcgcaaacac

SEQ ID NO: 2213 - DNA, 18 bp, Artificial Sequence
  source: /note="Description of Artificial Sequence: Synthetic oligonucleotide"
gggcctccctgcgcaaac

SEQ ID NO: 2214 - DNA, 18 bp, Artificial Sequence
  source: /note="Description of Artificial Sequence: Synthetic oligonucleotide"
cggggcctccctgcgcaa

SEQ ID NO: 2215 - DNA, 18 bp, Artificial Sequence
  source: /note="Description of Artificial Sequence: Synthetic oligonucleotide"
cgcggggcctccctgcgc

SEQ ID NO: 2216 - DNA, 18 bp, Artificial Sequence
  source: /note="Description of Artificial Sequence: Synthetic oligonucleotide"
agcgcggggcctccctgc

SEQ ID NO: 2217 - DNA, 18 bp, Artificial Sequence
  source: /note="Description of Artificial Sequence: Synthetic oligonucleotide"
ccagcgcggggcctccct

SEQ ID NO: 2218 - DNA, 18 bp, Artificial Sequence
  source: /note="Description of Artificial Sequence: Synthetic oligonucleotide"
tcccagcgcggggcctcc

SEQ ID NO: 2219 - DNA, 18 bp, Artificial Sequence
  source: /note="Description of Artificial Sequence: Synthetic oligonucleotide"
cgtcccagcgcggggcct

SEQ ID NO: 2220 - DNA, 18 bp, Artificial Sequence
  source: /note="Description of Artificial Sequence: Synthetic oligonucleotide"
ggcgtcccagcgcggggc

SEQ ID NO: 2221 - DNA, 18 bp, Artificial Sequence
  source: /note="Description of Artificial Sequence: Synthetic oligonucleotide"
ggggcgtcccagcgcggg

SEQ ID NO: 2222 - DNA, 18 bp, Artificial Sequence
  source: /note="Description of Artificial Sequence: Synthetic oligonucleotide"
aaggggcgtcccagcgcg

SEQ ID NO: 2223 - DNA, 18 bp, Artificial Sequence
  source: /note="Description of Artificial Sequence: Synthetic oligonucleotide"
caaaggggcgtcccagcg

SEQ ID NO: 2224 - DNA, 18 bp, Artificial Sequence
  source: /note="Description of Artificial Sequence: Synthetic oligonucleotide"
ctcaaaggggcgtcccag

SEQ ID NO: 2225 - DNA, 18 bp, Artificial Sequence
  source: /note="Description of Artificial Sequence: Synthetic oligonucleotide"
ccctcaaaggggcgtccc

SEQ ID NO: 2226 - DNA, 18 bp, Artificial Sequence
  source: /note="Description of Artificial Sequence: Synthetic oligonucleotide"
gtccctcaaaggggcgtc

SEQ ID NO: 2227 - DNA, 18 bp, Artificial Sequence
  source: /note="Description of Artificial Sequence: Synthetic oligonucleotide"
gggtccctcaaaggggcg

SEQ ID NO: 2228 - DNA, 18 bp, Artificial Sequence
  source: /note="Description of Artificial Sequence: Synthetic oligonucleotide"
ctgggtccctcaaagggg

SEQ ID NO: 2229 - DNA, 18 bp, Artificial Sequence
  source: /note="Description of Artificial Sequence: Synthetic oligonucleotide"
ggctgggtccctcaaagg

SEQ ID NO: 2230 - DNA, 18 bp, Artificial Sequence
  source: /note="Description of Artificial Sequence: Synthetic oligonucleotide"
aaggctgggtccctcaaa

SEQ ID NO: 2231 - DNA, 18 bp, Artificial Sequence
  source: /note="Description of Artificial Sequence: Synthetic oligonucleotide"
tcaaggctgggtccctca

SEQ ID NO: 2232 - DNA, 18 bp, Artificial Sequence
  source: /note="Description of Artificial Sequence: Synthetic oligonucleotide"
tctcaaggctgggtccct

SEQ ID NO: 2233 - DNA, 18 bp, Artificial Sequence
  source: /note="Description of Artificial Sequence: Synthetic oligonucleotide"
tgtctcaaggctgggtcc

SEQ ID NO: 2234 - DNA, 18 bp, Artificial Sequence
  source: /note="Description of Artificial Sequence: Synthetic oligonucleotide"
gctgtctcaaggctgggt

SEQ ID NO: 2235 - DNA, 18 bp, Artificial Sequence
  source: /note="Description of Artificial Sequence: Synthetic oligonucleotide"
cagctgtctcaaggctgg

SEQ ID NO: 2236 - DNA, 18 bp, Artificial Sequence
  source: /note="Description of Artificial Sequence: Synthetic oligonucleotide"
agcagctgtctcaaggct

SEQ ID NO: 2237 - DNA, 18 bp, Artificial Sequence
  source: /note="Description of Artificial Sequence: Synthetic oligonucleotide"
acagcagctgtctcaagg

SEQ ID NO: 2238 - DNA, 18 bp, Artificial Sequence
  source: /note="Description of Artificial Sequence: Synthetic oligonucleotide"
tcacagcagctgtctcaa

SEQ ID NO: 2239 - DNA, 18 bp, Artificial Sequence
  source: /note="Description of Artificial Sequence: Synthetic oligonucleotide"
gcctgcgtccgactccgc

SEQ ID NO: 2240 - DNA, 18 bp, Artificial Sequence
  source: /note="Description of Artificial Sequence: Synthetic oligonucleotide"
ctgcctgcgtccgactcc

SEQ ID NO: 2241 - DNA, 18 bp, Artificial Sequence
  source: /note="Description of Artificial Sequence: Synthetic oligonucleotide"
gtctgcctgcgtccgact

SEQ ID NO: 2242 - DNA, 18 bp, Artificial Sequence
  source: /note="Description of Artificial Sequence: Synthetic oligonucleotide"
tggtctgcctgcgtccga

SEQ ID NO: 2243 - DNA, 18 bp, Artificial Sequence
  source: /note="Description of Artificial Sequence: Synthetic oligonucleotide"
catggtctgcctgcgtcc

SEQ ID NO: 2244 - DNA, 18 bp, Artificial Sequence
  source: /note="Description of Artificial Sequence: Synthetic oligonucleotide"
cacatggtctgcctgcgt

SEQ ID NO: 2245 - DNA, 18 bp, Artificial Sequence
  source: /note="Description of Artificial Sequence: Synthetic oligonucleotide"
tccagaaggggacggcag

SEQ ID NO: 2246 - DNA, 18 bp, Artificial Sequence
  source: /note="Description of Artificial Sequence: Synthetic oligonucleotide"
tgtccagaaggggacggc

SEQ ID NO: 2247 - DNA, 18 bp, Artificial Sequence
  source: /note="Description of Artificial Sequence: Synthetic oligonucleotide"
tttgtccagaaggggacg

SEQ ID NO: 2248 - DNA, 18 bp, Artificial Sequence
  source: /note="Description of Artificial Sequence: Synthetic oligonucleotide"
catttgtccagaagggga

SEQ ID NO: 2249 - DNA, 18 bp, Artificial Sequence
  source: /note="Description of Artificial Sequence: Synthetic oligonucleotide"
gccatttgtccagaaggg

SEQ ID NO: 2250 - DNA, 18 bp, Artificial Sequence
  source: /note="Description of Artificial Sequence: Synthetic oligonucleotide"
gggccatttgtccagaag

SEQ ID NO: 2251 - DNA, 18 bp, Artificial Sequence
  source: /note="Description of Artificial Sequence: Synthetic oligonucleotide"
gtgggccatttgtccaga

SEQ ID NO: 2252 - DNA, 18 bp, Artificial Sequence
  source: /note="Description of Artificial Sequence: Synthetic oligonucleotide"
ttgtgggccatttgtcca

SEQ ID NO: 2253 - DNA, 18 bp, Artificial Sequence
  source: /note="Description of Artificial Sequence: Synthetic oligonucleotide"
ggcctctgggaaggggca

SEQ ID NO: 2254 - DNA, 18 bp, Artificial Sequence
  source: /note="Description of Artificial Sequence: Synthetic oligonucleotide"
acggcctctgggaagggg

SEQ ID NO: 2255 - DNA, 18 bp, Artificial Sequence
  source: /note="Description of Artificial Sequence: Synthetic oligonucleotide"
ccacggcctctgggaagg

SEQ ID NO: 2256 - DNA, 18 bp, Artificial Sequence
  source: /note="Description of Artificial Sequence: Synthetic oligonucleotide"
tgccacggcctctgggaa

SEQ ID NO: 2257 - DNA, 18 bp, Artificial Sequence
  source: /note="Description of Artificial Sequence: Synthetic oligonucleotide"
catgccacggcctctggg

SEQ ID NO: 2258 - DNA, 18 bp, Artificial Sequence
  source: /note="Description of Artificial Sequence: Synthetic oligonucleotide"
cgcatgccacggcctctg

SEQ ID NO: 2259 - DNA, 18 bp, Artificial Sequence
  source: /note="Description of Artificial Sequence: Synthetic oligonucleotide"
cccgcatgccacggcctc

SEQ ID NO: 2260 - DNA, 18 bp, Artificial Sequence
  source: /note="Description of Artificial Sequence: Synthetic oligonucleotide"
ttacctgatctttggaag

SEQ ID NO: 2261 - DNA, 18 bp, Artificial Sequence
  source: /note="Description of Artificial Sequence: Synthetic oligonucleotide"
tgttacctgatctttgga

SEQ ID NO: 2262 - DNA, 18 bp, Artificial Sequence
  source: /note="Description of Artificial Sequence: Synthetic oligonucleotide"
gttgttacctgatctttg

SEQ ID NO: 2263 - DNA, 18 bp, Artificial Sequence
  source: /note="Description of Artificial Sequence: Synthetic oligonucleotide"
gagttgttacctgatctt

SEQ ID NO: 2264 - DNA, 18 bp, Artificial Sequence
  source: /note="Description of Artificial Sequence: Synthetic oligonucleotide"
cggagttgttacctgatc

SEQ ID NO: 2265 - DNA, 18 bp, Artificial Sequence
  source: /note="Description of Artificial Sequence: Synthetic oligonucleotide"
cacggagttgttacctga

SEQ ID NO: 2266 - DNA, 18 bp, Artificial Sequence
  source: /note="Description of Artificial Sequence: Synthetic oligonucleotide"
agcctggggcatggggca

SEQ ID NO: 2267 - DNA, 18 bp, Artificial Sequence
  source: /note="Description of Artificial Sequence: Synthetic oligonucleotide"
gaagcctggggcatgggg

SEQ ID NO: 2268 - DNA, 18 bp, Artificial Sequence
  source: /note="Description of Artificial Sequence: Synthetic oligonucleotide"
aggaagcctggggcatgg

SEQ ID NO: 2269 - DNA, 18 bp, Artificial Sequence
  source: /note="Description of Artificial Sequence: Synthetic oligonucleotide"
gcaggaagcctggggcat

SEQ ID NO: 2270 - DNA, 18 bp, Artificial Sequence
  source: /note="Description of Artificial Sequence: Synthetic oligonucleotide"
cagcaggaagcctggggc

SEQ ID NO: 2271 - DNA, 18 bp, Artificial Sequence
  source: /note="Description of Artificial Sequence: Synthetic oligonucleotide"
cacagcaggaagcctggg

SEQ ID NO: 2272 - DNA, 18 bp, Artificial Sequence
  source: /note="Description of Artificial Sequence: Synthetic oligonucleotide"
actgccctgttagtcctc

SEQ ID NO: 2273 - DNA, 18 bp, Artificial Sequence
  source: /note="Description of Artificial Sequence: Synthetic oligonucleotide"
ccactgccctgttagtcc

SEQ ID NO: 2274 - DNA, 18 bp, Artificial Sequence
  source: /note="Description of Artificial Sequence: Synthetic oligonucleotide"
ggccactgccctgttagt

SEQ ID NO: 2275 - DNA, 18 bp, Artificial Sequence
  source: /note="Description of Artificial Sequence: Synthetic oligonucleotide"
aaggccactgccctgtta

SEQ ID NO: 2276 - DNA, 18 bp, Artificial Sequence
  source: /note="Description of Artificial Sequence: Synthetic oligonucleotide"
acaaggccactgccctgt

SEQ ID NO: 2277 - DNA, 18 bp, Artificial Sequence
  source: /note="Description of Artificial Sequence: Synthetic oligonucleotide"
ggacaaggccactgccct

SEQ ID NO: 2278 - DNA, 18 bp, Artificial Sequence
  source: /note="Description of Artificial Sequence: Synthetic oligonucleotide"
ctggacaaggccactgcc

SEQ ID NO: 2279 - DNA, 18 bp, Artificial Sequence
  source: /note="Description of Artificial Sequence: Synthetic oligonucleotide"
gcgttgggcattgggcag

SEQ ID NO: 2280 - DNA, 18 bp, Artificial Sequence
  source: /note="Description of Artificial Sequence: Synthetic oligonucleotide"
tggcgttgggcattgggc

SEQ ID NO: 2281 - DNA, 18 bp, Artificial Sequence
  source: /note="Description of Artificial Sequence: Synthetic oligonucleotide"
ggtggcgttgggcattgg

SEQ ID NO: 2282 - DNA, 18 bp, Artificial Sequence
  source: /note="Description of Artificial Sequence: Synthetic oligonucleotide"
caggtggcgttgggcatt

SEQ ID NO: 2283 - DNA, 18 bp, Artificial Sequence
  source: /note="Description of Artificial Sequence: Synthetic oligonucleotide"
agcaggtggcgttgggca

SEQ ID NO: 2284 - DNA, 18 bp, Artificial Sequence
  source: /note="Description of Artificial Sequence: Synthetic oligonucleotide"
gcagcaggtggcgttggg

SEQ ID NO: 2285 - DNA, 18 bp, Artificial Sequence
  source: /note="Description of Artificial Sequence: Synthetic oligonucleotide"
gagcagcaggtggcgttg

SEQ ID NO: 2286 - DNA, 18 bp, Artificial Sequence
  source: /note="Description of Artificial Sequence: Synthetic oligonucleotide"
cggagcagcaggtggcgt

SEQ ID NO: 2287 - DNA, 18 bp, Artificial Sequence
  source: /note="Description of Artificial Sequence: Synthetic oligonucleotide"
actgtgtgcgcaggcagc

SEQ ID NO: 2288 - DNA, 18 bp, Artificial Sequence
  source: /note="Description of Artificial Sequence: Synthetic oligonucleotide"
ccactgtgtgcgcaggca

SEQ ID NO: 2289 - DNA, 18 bp, Artificial Sequence
  source: /note="Description of Artificial Sequence: Synthetic oligonucleotide"
ccccactgtgtgcgcagg

SEQ ID NO: 2290 - DNA, 18 bp, Artificial Sequence
  source: /note="Description of Artificial Sequence: Synthetic oligonucleotide"
tcccccactgtgtgcgca

SEQ ID NO: 2291 - DNA, 18 bp, Artificial Sequence
  source: /note="Description of Artificial Sequence: Synthetic oligonucleotide"
catcccccactgtgtgcg

SEQ ID NO: 2292 - DNA, 18 bp, Artificial Sequence
  source: /note="Description of Artificial Sequence: Synthetic oligonucleotide"
cacatcccccactgtgtg

SEQ ID NO: 2293 - DNA, 18 bp, Artificial Sequence
  source: /note="Description of Artificial Sequence: Synthetic oligonucleotide"
gcctgggtaaaagggcag

SEQ ID NO: 2294 - DNA, 18 bp, Artificial Sequence
  source: /note="Description of Artificial Sequence: Synthetic oligonucleotide"
cagcctgggtaaaagggc

SEQ ID NO: 2295 - DNA, 18 bp, Artificial Sequence
  source: /note="Description of Artificial Sequence: Synthetic oligonucleotide"
cacagcctgggtaaaagg

SEQ ID NO: 2296 - DNA, 18 bp, Artificial Sequence
  source: /note="Description of Artificial Sequence: Synthetic oligonucleotide"
cacacagcctgggtaaaa

SEQ ID NO: 2297 - DNA, 18 bp, Artificial Sequence
  source: /note="Description of Artificial Sequence: Synthetic oligonucleotide"
agcacacagcctgggtaa

SEQ ID NO: 2298 - DNA, 18 bp, Artificial Sequence
  source: /note="Description of Artificial Sequence: Synthetic oligonucleotide"
acagcacacagcctgggt

SEQ ID NO: 2299 - DNA, 18 bp, Artificial Sequence
  source: /note="Description of Artificial Sequence: Synthetic oligonucleotide"
tcacagcacacagcctgg

SEQ ID NO: 2300 - DNA, 18 bp, Artificial Sequence
  source: /note="Description of Artificial Sequence: Synthetic oligonucleotide"
gcctctgggattggacag

SEQ ID NO: 2301 - DNA, 18 bp, Artificial Sequence
  source: /note="Description of Artificial Sequence: Synthetic oligonucleotide"
cagcctctgggattggac

SEQ ID NO: 2302 - DNA, 18 bp, Artificial Sequence
  source: /note="Description of Artificial Sequence: Synthetic oligonucleotide"
gacagcctctgggattgg

SEQ ID NO: 2303 - DNA, 18 bp, Artificial Sequence
  source: /note="Description of Artificial Sequence: Synthetic oligonucleotide"
cagacagcctctgggatt

SEQ ID NO: 2304 - DNA, 18 bp, Artificial Sequence
  source: /note="Description of Artificial Sequence: Synthetic oligonucleotide"
agcagacagcctctggga

SEQ ID NO: 2305 - DNA, 18 bp, Artificial Sequence
  source: /note="Description of Artificial Sequence: Synthetic oligonucleotide"
gcagcagacagcctctgg

SEQ ID NO: 2306 - DNA, 18 bp, Artificial Sequence
  source: /note="Description of Artificial Sequence: Synthetic oligonucleotide"
gagcagcagacagcctct

SEQ ID NO: 2307 - DNA, 18 bp, Artificial Sequence
  source: /note="Description of Artificial Sequence: Synthetic oligonucleotide"
gcatggggcaactggcag

SEQ ID NO: 2308 - DNA, 18 bp, Artificial Sequence
  source: /note="Description of Artificial Sequence: Synthetic oligonucleotide"
cagcatggggcaactggc

SEQ ID NO: 2309 - DNA, 18 bp, Artificial Sequence
  source: /note="Description of Artificial Sequence: Synthetic oligonucleotide"
cacagcatggggcaactg

SEQ ID NO: 2310 - DNA, 18 bp, Artificial Sequence
  source: /note="Description of Artificial Sequence: Synthetic oligonucleotide"
cacacagcatggggcaac

SEQ ID NO: 2311 - DNA, 18 bp, Artificial Sequence
  source: /note="Description of Artificial Sequence: Synthetic oligonucleotide"
agcacacagcatggggca

SEQ ID NO: 2312 - DNA, 18 bp, Artificial Sequence
  source: /note="Description of Artificial Sequence: Synthetic oligonucleotide"
gcagcacacagcatgggg

SEQ ID NO: 2313 - DNA, 18 bp, Artificial Sequence
  source: /note="Description of Artificial Sequence: Synthetic oligonucleotide"
tcgcagcacacagcatgg

SEQ ID NO: 2314 - DNA, 18 bp, Artificial Sequence
  source: /note="Description of Artificial Sequence: Synthetic oligonucleotide"
cctcgcagcacacagcat

SEQ ID NO: 2315 - DNA, 18 bp, Artificial Sequence
  source: /note="Description of Artificial Sequence: Synthetic oligonucleotide"
ccctggcggtagggacag

SEQ ID NO: 2316 - DNA, 18 bp, Artificial Sequence
  source: /note="Description of Artificial Sequence: Synthetic oligonucleotide"
cgccctggcggtagggac

SEQ ID NO: 2317 - DNA, 18 bp, Artificial Sequence
  source: /note="Description of Artificial Sequence: Synthetic oligonucleotide"
gacgccctggcggtaggg

SEQ ID NO: 2318 - DNA, 18 bp, Artificial Sequence
  source: /note="Description of Artificial Sequence: Synthetic oligonucleotide"
cagacgccctggcggtag

SEQ ID NO: 2319 - DNA, 18 bp, Artificial Sequence
  source: /note="Description of Artificial Sequence: Synthetic oligonucleotide"
aacagacgccctggcggt

SEQ ID NO: 2320 - DNA, 18 bp, Artificial Sequence
  source: /note="Description of Artificial Sequence: Synthetic oligonucleotide"
acaacagacgccctggcg

SEQ ID NO: 2321 - DNA, 18 bp, Homo sapiens
tcacatgatccctagaaa

SEQ ID NO: 2322 - DNA, 18 bp, Homo sapiens
acatgatccctagaaatg

SEQ ID NO: 2323 - DNA, 18 bp, Homo sapiens
atgatccctagaaatggg

SEQ ID NO: 2324 - DNA, 18 bp, Homo sapiens
gatccctagaaatggggt

SEQ ID NO: 2325 - DNA, 18 bp, Homo sapiens
tccctagaaatggggtgt

SEQ ID NO: 2326 - DNA, 18 bp, Homo sapiens
cctagaaatggggtgtgg

SEQ ID NO: 2327 - DNA, 18 bp, Homo sapiens
tagaaatggggtgtgggg

SEQ ID NO: 2328 - DNA, 18 bp, Homo sapiens
gaaatggggtgtggggcg

SEQ ID NO: 2329 - DNA, 18 bp, Homo sapiens
aatggggtgtggggcgag

SEQ ID NO: 2330 - DNA, 18 bp, Homo sapiens
tggggtgtggggcgagag

SEQ ID NO: 2331 - DNA, 18 bp, Homo sapiens
gggtgtggggcgagagga

SEQ ID NO: 2332 - DNA, 18 bp, Homo sapiens
gtgtggggcgagaggaag

SEQ ID NO: 2333 - DNA, 18 bp, Homo sapiens
gtggggcgagaggaagca

SEQ ID NO: 2334 - DNA, 18 bp, Homo sapiens
ggggcgagaggaagcagg

SEQ ID NO: 2335 - DNA, 18 bp, Homo sapiens
agccctgatccctggcca

SEQ ID NO: 2336 - DNA, 18 bp, Homo sapiens
gccctgatccctggccaa

SEQ ID NO: 2337 - DNA, 18 bp, Homo sapiens
ccctgatccctggccaat

SEQ ID NO: 2338 - DNA, 16 bp, Homo sapiens
ccctgatccctggcca

SEQ ID NO: 2339 - DNA, 18 bp, Homo sapiens
ccgcggagtcggacgcag

SEQ ID NO: 2340 - DNA, 18 bp, Homo sapiens
gcggagtcggacgcaggt

SEQ ID NO: 2341 - DNA, 18 bp, Homo sapiens
ggagtcggacgcaggtag

SEQ ID NO: 2342 - DNA, 18 bp, Homo sapiens
agtcggacgcaggtagga

SEQ ID NO: 2343 - DNA, 18 bp, Homo sapiens
tcggacgcaggtaggaga

SEQ ID NO: 2344 - DNA, 18 bp, Homo sapiens
ggacgcaggtaggagagc

SEQ ID NO: 2345 - DNA, 18 bp, Homo sapiens
acgcaggtaggagagcgg

SEQ ID NO: 2346 - DNA, 18 bp, Homo sapiens
gcaggtaggagagcggcc

SEQ ID NO: 2347 - DNA, 18 bp, Homo sapiens
aggtaggagagcggccgc

SEQ ID NO: 2348 - DNA, 18 bp, Homo sapiens
gtaggagagcggccgcgc

SEQ ID NO: 2349 - DNA, 18 bp, Homo sapiens
aggagagcggccgcgcag

SEQ ID NO: 2350 - DNA, 18 bp, Homo sapiens
gagagcggccgcgcagac

SEQ ID NO: 2351 - DNA, 18 bp, Homo sapiens
gagcggccgcgcagacct

SEQ ID NO: 2352 - DNA, 18 bp, Homo sapiens
gcggccgcgcagacctct

SEQ ID NO: 2353 - DNA, 18 bp, Homo sapiens
ggccgcgcagacctctcg

SEQ ID NO: 2354 - DNA, 18 bp, Homo sapiens
ccgcgcagacctctcgcc

SEQ ID NO: 2355 - DNA, 18 bp, Homo sapiens
gcgcagacctctcgcctg

SEQ ID NO: 2356 - DNA, 18 bp, Homo sapiens
gcagacctctcgcctgct

SEQ ID NO: 2357 - DNA, 18 bp, Homo sapiens
agacctctcgcctgctcc

SEQ ID NO: 2358 - DNA, 18 bp, Homo sapiens
acctctcgcctgctcctg

SEQ ID NO: 2359 - DNA, 18 bp, Homo sapiens
ctctcgcctgctcctgcc

SEQ ID NO: 2360 - DNA, 18 bp, Homo sapiens
ctcgcctgctcctgccca

SEQ ID NO: 2361 - DNA, 18 bp, Homo sapiens
cgcctgctcctgcccagg

SEQ ID NO: 2362 - DNA, 18 bp, Homo sapiens
cctgctcctgcccagggg

SEQ ID NO: 2363 - DNA, 18 bp, Homo sapiens
tgctcctgcccaggggcc

SEQ ID NO: 2364 - DNA, 18 bp, Homo sapiens
ctcctgcccaggggcccg

SEQ ID NO: 2365 - DNA, 18 bp, Homo sapiens
cctgcccaggggcccgcc

SEQ ID NO: 2366 - DNA, 18 bp, Homo sapiens
tgcccaggggcccgccag

SEQ ID NO: 2367 - DNA, 18 bp, Homo sapiens
cccaggggcccgccaggg

SEQ ID NO: 2368 - DNA, 18 bp, Homo sapiens
caggggcccgccagggcc

SEQ ID NO: 2369 - DNA, 18 bp, Homo sapiens
ggggcccgccagggccat

SEQ ID NO: 2370 - DNA, 18 bp, Homo sapiens
ggcccgccagggccatgt

SEQ ID NO: 2371 - DNA, 18 bp, Homo sapiens
cccgccagggccatgtga

SEQ ID NO: 2372 - DNA, 18 bp, Homo sapiens
cgccagggccatgtgagc

SEQ ID NO: 2373 - DNA, 18 bp, Homo sapiens
ccagggccatgtgagctt

SEQ ID NO: 2374 - DNA, 18 bp, Homo sapiens
agggccatgtgagcttga

SEQ ID NO: 2375 - DNA, 18 bp, Homo sapiens
gggccatgtgagcttgag

SEQ ID NO: 2376 - DNA, 18 bp, Homo sapiens
ggccatgtgagcttgagg

SEQ ID NO: 2377 - DNA, 16 bp, Homo sapiens
gccatgtgagcttgag

SEQ ID NO: 2378 - DNA, 18 bp, Homo sapiens
gccatgtgagcttgaggt

SEQ ID NO: 2379 - DNA, 18 bp, Homo sapiens
ccatgtgagcttgaggtt

SEQ ID NO: 2380 - DNA, 18 bp, Homo sapiens
atgtgagcttgaggttcc

SEQ ID NO: 2381 - DNA, 18 bp, Homo sapiens
gtgagcttgaggttcccc

SEQ ID NO: 2382 - DNA, 18 bp, Homo sapiens
gagcttgaggttcccctg

SEQ ID NO: 2383 - DNA, 18 bp, Homo sapiens
gcttgaggttcccctgga

SEQ ID NO: 2384 - DNA, 18 bp, Homo sapiens
ttgaggttcccctggagt

SEQ ID NO: 2385 - DNA, 18 bp, Homo sapiens
gaggttcccctggagtct

SEQ ID NO: 2386 - DNA, 18 bp, Homo sapiens
ggttcccctggagtctca

SEQ ID NO: 2387 - DNA, 18 bp, Homo sapiens
ttcccctggagtctcagc

SEQ ID NO: 2388 - DNA, 18 bp, Homo sapiens
cccctggagtctcagccg

SEQ ID NO: 2389 - DNA, 18 bp, Homo sapiens
cctggagtctcagccgga

SEQ ID NO: 2390 - DNA, 18 bp, Homo sapiens
tggagtctcagccggaga

SEQ ID NO: 2391 - DNA, 18 bp, Homo sapiens
gagtctcagccggagaca

SEQ ID NO: 2392 - DNA, 18 bp, Homo sapiens
gtctcagccggagacaac

SEQ ID NO: 2393 - DNA, 18 bp, Homo sapiens
ctcagccggagacaacag

SEQ ID NO: 2394 - DNA, 18 bp, Homo sapiens
cagccggagacaacagaa

SEQ ID NO: 2395 - DNA, 18 bp, Homo sapiens
gccggagacaacagaaga

SEQ ID NO: 2396 - DNA, 18 bp, Homo sapiens
cggagacaacagaagaac

SEQ ID NO: 2397 - DNA, 18 bp, Homo sapiens
gagacaacagaagaaccg

SEQ ID NO: 2398 - DNA, 18 bp, Homo sapiens
gacaacagaagaaccgct

SEQ ID NO: 2399 - DNA, 18 bp, Homo sapiens
caacagaagaaccgctta

SEQ ID NO: 2400 - DNA, 18 bp, Homo sapiens
acagaagaaccgcttact

SEQ ID NO: 2401 - DNA, 18 bp, Homo sapiens
agaagaaccgcttactga

SEQ ID NO: 2402 - DNA, 18 bp, Homo sapiens
aagaaccgcttactgaaa

SEQ ID NO: 2403 - DNA, 18 bp, Homo sapiens
gaaccgcttactgaaact

SEQ ID NO: 2404 - DNA, 18 bp, Homo sapiens
accgcttactgaaactcc

SEQ ID NO: 2405 - DNA, 18 bp, Homo sapiens
cgcttactgaaactcctt

SEQ ID NO: 2406 - DNA, 18 bp, Homo sapiens
cttactgaaactccttgg

SEQ ID NO: 2407 - DNA, 18 bp, Homo sapiens
tactgaaactccttgggg

SEQ ID NO: 2408 - DNA, 18 bp, Homo sapiens
ctgaaactccttgggggt

SEQ ID NO: 2409 - DNA, 18 bp, Homo sapiens
gaaactccttgggggttc

SEQ ID NO: 2410 - DNA, 18 bp, Homo sapiens
aactccttgggggttctg

SEQ ID NO: 2411 - DNA, 18 bp, Homo sapiens
ctccttgggggttctgat

SEQ ID NO: 2412 - DNA, 18 bp, Homo sapiens
ccttgggggttctgatac

SEQ ID NO: 2413 - DNA, 18 bp, Homo sapiens
ttgggggttctgatacac

SEQ ID NO: 2414 - DNA, 18 bp, Homo sapiens
gggggttctgatacacta

SEQ ID NO: 2415 - DNA, 18 bp, Homo sapiens
gggttctgatacactagg

SEQ ID NO: 2416 - DNA, 18 bp, Homo sapiens
gttctgatacactagggg

SEQ ID NO: 2417 - DNA, 18 bp, Homo sapiens
tctgatacactaggggga

SEQ ID NO: 2418 - DNA, 18 bp, Homo sapiens
tgatacactagggggagt

SEQ ID NO: 2419 - DNA, 18 bp, Homo sapiens
atacactagggggagttt

SEQ ID NO: 2420 - DNA, 18 bp, Homo sapiens
acactagggggagtttta

SEQ ID NO: 2421 - DNA, 18 bp, Homo sapiens
actagggggagttttatg

SEQ ID NO: 2422 - DNA, 18 bp, Homo sapiens
tagggggagttttatggg

SEQ ID NO: 2423 - DNA, 18 bp, Homo sapiens
gggggagttttatgggaa

SEQ ID NO: 2424 - DNA, 18 bp, Homo sapiens
gggagttttatgggaaag

SEQ ID NO: 2425 - DNA, 18 bp, Homo sapiens
gagttttatgggaaagag

SEQ ID NO: 2426 - DNA, 18 bp, Homo sapiens
gttttatgggaaagagga

SEQ ID NO: 2427 - DNA, 18 bp, Homo sapiens
tttatgggaaagaggaag

SEQ ID NO: 2428 - DNA, 18 bp, Homo sapiens
tatgggaaagaggaagca

SEQ ID NO: 2429 - DNA, 18 bp, Homo sapiens
tgggaaagaggaagcagt

SEQ ID NO: 2430 - DNA, 18 bp, Homo sapiens
ggaaagaggaagcagtaa

SEQ ID NO: 2431 - DNA, 18 bp, Homo sapiens
aaagaggaagcagtaatt

SEQ ID NO: 2432 - DNA, 18 bp, Homo sapiens
agaggaagcagtaattgc

SEQ ID NO: 2433 - DNA, 18 bp, Homo sapiens
aggaagcagtaattgcag

SEQ ID NO: 2434 - DNA, 18 bp, Homo sapiens
gaagcagtaattgcagtg

SEQ ID NO: 2435 - DNA, 18 bp, Homo sapiens
agcagtaattgcagtgac

SEQ ID NO: 2436 - DNA, 18 bp, Homo sapiens
cagtaattgcagtgacgc

SEQ ID NO: 2437 - DNA, 18 bp, Homo sapiens
gtaattgcagtgacgccc

SEQ ID NO: 2438 - DNA, 18 bp, Homo sapiens
aattgcagtgacgccccg

SEQ ID NO: 2439 - DNA, 18 bp, Homo sapiens
ttgcagtgacgccccgtt

SEQ ID NO: 2440 - DNA, 18 bp, Homo sapiens
gcagtgacgccccgttag

SEQ ID NO: 2441 - DNA, 18 bp, Homo sapiens
agtgacgccccgttagaa

SEQ ID NO: 2442 - DNA, 18 bp, Homo sapiens
tgacgccccgttagaagg

SEQ ID NO: 2443 - DNA, 18 bp, Homo sapiens
acgccccgttagaagggg

SEQ ID NO: 2444 - DNA, 18 bp, Homo sapiens
gccccgttagaaggggct

SEQ ID NO: 2445 - DNA, 18 bp, Homo sapiens
cccgttagaaggggcttt

SEQ ID NO: 2446 - DNA, 18 bp, Homo sapiens
cgttagaaggggctttct

SEQ ID NO: 2447 - DNA, 18 bp, Homo sapiens
ttagaaggggctttctac

SEQ ID NO: 2448 - DNA, 18 bp, Homo sapiens
agaaggggctttctacct

SEQ ID NO: 2449 - DNA, 18 bp, Homo sapiens
aaggggctttctacctcc

SEQ ID NO: 2450 - DNA, 18 bp, Homo sapiens
ggggctttctacctcccc

SEQ ID NO: 2451 - DNA, 18 bp, Homo sapiens
ggctttctacctccccag

SEQ ID NO: 2452 - DNA, 18 bp, Homo sapiens
ctttctacctccccagca

SEQ ID NO: 2453 - DNA, 18 bp, Homo sapiens
ttctacctccccagcatt

SEQ ID NO: 2454 - DNA, 18 bp, Homo sapiens
ctacctccccagcattcc

SEQ ID NO: 2455 - DNA, 18 bp, Homo sapiens
acctccccagcattcccc

SEQ ID NO: 2456 - DNA, 18 bp, Homo sapiens
ctccccagcattccccca

SEQ ID NO: 2457 - DNA, 18 bp, Homo sapiens
ccccagcattcccccaaa

SEQ ID NO: 2458 - DNA, 18 bp, Homo sapiens
ccagcattcccccaaagc

SEQ ID NO: 2459 - DNA, 18 bp, Homo sapiens
agcattcccccaaagcag

SEQ ID NO: 2460 - DNA, 18 bp, Homo sapiens
cattcccccaaagcaggg

SEQ ID NO: 2461 - DNA, 18 bp, Homo sapiens
ttcccccaaagcagggac

SEQ ID NO: 2462 - DNA, 18 bp, Homo sapiens
cccccaaagcagggacca

SEQ ID NO: 2463 - DNA, 18 bp, Homo sapiens
cccaaagcagggaccaca

SEQ ID NO: 2464 - DNA, 18 bp, Homo sapiens
caaagcagggaccacacc

SEQ ID NO: 2465 - DNA, 18 bp, Homo sapiens
aagcagggaccacaccat

SEQ ID NO: 2466 - DNA, 18 bp, Homo sapiens
gcagggaccacaccattc

SEQ ID NO: 2467 - DNA, 18 bp, Homo sapiens
cagggaccacaccattct

SEQ ID NO: 2468 - DNA, 16 bp, Homo sapiens
agggaccacaccattc

SEQ ID NO: 2469 - DNA, 18 bp, Homo sapiens
agggaccacaccattctt

SEQ ID NO: 2470 - DNA, 18 bp, Homo sapiens
gggaccacaccattcttg

SEQ ID NO: 2471 - DNA, 18 bp, Homo sapiens
ggaccacaccattcttga

SEQ ID NO: 2472 - DNA, 16 bp, Homo sapiens
gaccacaccattcttg

SEQ ID NO: 2473 - DNA, 18 bp, Homo sapiens
gaccacaccattcttgac

SEQ ID NO: 2474 - DNA, 18 bp, Homo sapiens
accacaccattcttgacc

SEQ ID NO: 2475 - DNA, 18 bp, Homo sapiens
ccacaccattcttgaccc

SEQ ID NO: 2476 - DNA, 16 bp, Homo sapiens
cacaccattcttgacc

SEQ ID NO: 2477 - DNA, 18 bp, Homo sapiens
cacaccattcttgaccca

SEQ ID NO: 2478 - DNA, 18 bp, Homo sapiens
caccattcttgacccagc

SEQ ID NO: 2479 - DNA, 18 bp, Homo sapiens
ccattcttgacccagctc

SEQ ID NO: 2480 - DNA, 18 bp, Homo sapiens
attcttgacccagctcca

SEQ ID NO: 2481 - DNA, 18 bp, Homo sapiens
tcttgacccagctccacc

SEQ ID NO: 2482 - DNA, 18 bp, Homo sapiens
ttgacccagctccacccc

SEQ ID NO: 2483 - DNA, 18 bp, Homo sapiens
gacccagctccacccctg

SEQ ID NO: 2484 - DNA, 18 bp, Homo sapiens
cccagctccacccctgtc

SEQ ID NO: 2485 - DNA, 18 bp, Homo sapiens
cagctccacccctgtcgg

SEQ ID NO: 2486 - DNA, 18 bp, Homo sapiens
gctccacccctgtcggta

SEQ ID NO: 2487 - DNA, 18 bp, Homo sapiens
tccacccctgtcggtagg

SEQ ID NO: 2488 - DNA, 18 bp, Homo sapiens
cacccctgtcggtaggtg

SEQ ID NO: 2489 - DNA, 18 bp, Homo sapiens
cccctgtcggtaggtgct

SEQ ID NO: 2490 - DNA, 18 bp, Homo sapiens
cctgtcggtaggtgctgg

SEQ ID NO: 2491 - DNA, 18 bp, Homo sapiens
tgtcggtaggtgctggct

SEQ ID NO: 2492 - DNA, 18 bp, Homo sapiens
tcggtaggtgctggcttc

SEQ ID NO: 2493 - DNA, 18 bp, Homo sapiens
ggtaggtgctggcttctt

SEQ ID NO: 2494 - DNA, 18 bp, Homo sapiens
taggtgctggcttcttcc

SEQ ID NO: 2495 - DNA, 18 bp, Homo sapiens
ggtgctggcttcttcccc

SEQ ID NO: 2496 - DNA, 18 bp, Homo sapiens
tgctggcttcttcccctc

SEQ ID NO: 2497 - DNA, 18 bp, Homo sapiens
ctggcttcttcccctctc

SEQ ID NO: 2498 - DNA, 18 bp, Homo sapiens
ggcttcttcccctctcct

SEQ ID NO: 2499 - DNA, 18 bp, Homo sapiens
cttcttcccctctcctgg

SEQ ID NO: 2500 - DNA, 18 bp, Homo sapiens
tcttcccctctcctggtg

SEQ ID NO: 2501 - DNA, 18 bp, Homo sapiens
ttcccctctcctggtggt

SEQ ID NO: 2502 - DNA, 18 bp, Homo sapiens
cccctctcctggtggtgg

SEQ ID NO: 2503 - DNA, 18 bp, Homo sapiens
cctctcctggtggtggtg

SEQ ID NO: 2504 - DNA, 18 bp, Homo sapiens
tctcctggtggtggtggg

SEQ ID NO: 2505 - DNA, 18 bp, Homo sapiens
tcctggtggtggtgggtg

SEQ ID NO: 2506 - DNA, 18 bp, Homo sapiens
ctggtggtggtgggtggt

SEQ ID NO: 2507 - DNA, 18 bp, Homo sapiens
ggtggtggtgggtggttc

SEQ ID NO: 2508 - DNA, 18 bp, Homo sapiens
tggtggtgggtggttccc

SEQ ID NO: 2509 - DNA, 18 bp, Homo sapiens
gtggtgggtggttcccgc

SEQ ID NO: 2510 - DNA, 18 bp, Homo sapiens
tttagggtaaacaggagg

SEQ ID NO: 2511 - DNA, 18 bp, Homo sapiens
tagggtaaacaggagggg

SEQ ID NO: 2512 - DNA, 18 bp, Homo sapiens
gggtaaacaggaggggcc

SEQ ID NO: 2513 - DNA, 18 bp, Homo sapiens
gtaaacaggaggggccac

SEQ ID NO: 2514 - DNA, 18 bp, Homo sapiens
aaacaggaggggccacat

SEQ ID NO: 2515 - DNA, 18 bp, Homo sapiens
acaggaggggccacatgc

SEQ ID NO: 2516 - DNA, 18 bp, Homo sapiens
aggaggggccacatgcac

SEQ ID NO: 2517 - DNA, 18 bp, Homo sapiens
gaggggccacatgcacag

SEQ ID NO: 2518 - DNA, 18 bp, Homo sapiens
ggggccacatgcacaggt

SEQ ID NO: 2519 - DNA, 18 bp, Homo sapiens
ggccacatgcacaggtaa

SEQ ID NO: 2520 - DNA, 18 bp, Homo sapiens
ccacatgcacaggtaatt

SEQ ID NO: 2521 - DNA, 18 bp, Homo sapiens
acatgcacaggtaattca

SEQ ID NO: 2522 - DNA, 18 bp, Homo sapiens
atgcacaggtaattcacc

SEQ ID NO: 2523 - DNA, 18 bp, Homo sapiens
gcacaggtaattcaccag

SEQ ID NO: 2524 - DNA, 18 bp, Homo sapiens
acaggtaattcaccaggg

SEQ ID NO: 2525 - DNA, 18 bp, Homo sapiens
aggtaattcaccagggag

SEQ ID NO: 2526 - DNA, 18 bp, Homo sapiens
gtaattcaccagggagcc

SEQ ID NO: 2527 - DNA, 18 bp, Homo sapiens
aattcaccagggagccga

SEQ ID NO: 2528 - DNA, 18 bp, Homo sapiens
ttcaccagggagccgaac

SEQ ID NO: 2529 - DNA, 18 bp, Homo sapiens
caccagggagccgaacac

SEQ ID NO: 2530 - DNA, 18 bp, Homo sapiens
ccagggagccgaacactc

SEQ ID NO: 2531 - DNA, 18 bp, Homo sapiens
agggagccgaacactcct

SEQ ID NO: 2532 - DNA, 18 bp, Homo sapiens
ggagccgaacactcctgt

SEQ ID NO: 2533 - DNA, 18 bp, Homo sapiens
agccgaacactcctgtgc

SEQ ID NO: 2534 - DNA, 18 bp, Homo sapiens
cccccgcagtggtatcca

SEQ ID NO: 2535 - DNA, 18 bp, Homo sapiens
cccgcagtggtatccaca

SEQ ID NO: 2536 - DNA, 18 bp, Homo sapiens
cgcagtggtatccacacc

SEQ ID NO: 2537 - DNA, 18 bp, Homo sapiens
cctgttgcaccattccca

SEQ ID NO: 2538 - DNA, 18 bp, Homo sapiens
tgttgcaccattcccagg

SEQ ID NO: 2539 - DNA, 18 bp, Homo sapiens
ttgcaccattcccaggca

SEQ ID NO: 2540 - DNA, 18 bp, Homo sapiens
gcaccattcccaggcact

SEQ ID NO: 2541 - DNA, 18 bp, Homo sapiens
gtgacgtgttataggtgt

SEQ ID NO: 2542 - DNA, 18 bp, Homo sapiens
gacgtgttataggtgtcc

SEQ ID NO: 2543 - DNA, 18 bp, Homo sapiens
cgtgttataggtgtccct

SEQ ID NO: 2544 - DNA, 18 bp, Homo sapiens
gaaatgacatgtcggctg

SEQ ID NO: 2545 - DNA, 18 bp, Homo sapiens
aatgacatgtcggctggg

SEQ ID NO: 2546 - DNA, 18 bp, Homo sapiens
tgacatgtcggctgggcg

SEQ ID NO: 2547 - DNA, 18 bp, Homo sapiens
acatgtcggctgggcgtg

SEQ ID NO: 2548 - DNA, 18 bp, Homo sapiens
atgtcggctgggcgtggt

SEQ ID NO: 2549 - DNA, 18 bp, Homo sapiens
aagaaaaagaaatgccat

SEQ ID NO: 2550 - DNA, 18 bp, Homo sapiens
gaaaaagaaatgccatgt

SEQ ID NO: 2551 - DNA, 18 bp, Homo sapiens
aaaagaaatgccatgtaa

SEQ ID NO: 2552 - DNA, 18 bp, Homo sapiens
aagaaatgccatgtaaat

SEQ ID NO: 2553 - DNA, 18 bp, Homo sapiens
atgcacccatcgtaagcc

SEQ ID NO: 2554 - DNA, 18 bp, Homo sapiens
gcacccatcgtaagccta

SEQ ID NO: 2555 - DNA, 18 bp, Homo sapiens
acccatcgtaagcctaac

SEQ ID NO: 2556 - DNA, 18 bp, Homo sapiens
ccatcgtaagcctaacta

SEQ ID NO: 2557 - DNA, 18 bp, Homo sapiens
cattttcaggggtttttt

SEQ ID NO: 2558 - DNA, 18 bp, Homo sapiens
ttttcaggggtttttttg

SEQ ID NO: 2559 - DNA, 18 bp, Homo sapiens
ttcaggggtttttttgtt

SEQ ID NO: 2560 - DNA, 18 bp, Homo sapiens
ccaccgcgcccaatatat

SEQ ID NO: 2561 - DNA, 18 bp, Homo sapiens
accgcgcccaatatattt

SEQ ID NO: 2562 - DNA, 18 bp, Homo sapiens
cgcgcccaatatattttg

SEQ ID NO: 2563 - DNA, 18 bp, Homo sapiens
cgcccaatatattttgat

SEQ ID NO: 2564 - DNA, 18 bp, Homo sapiens
gagggctgactgtactta

SEQ ID NO: 2565 - DNA, 18 bp, Homo sapiens
gggctgactgtacttaac

SEQ ID NO: 2566 - DNA, 18 bp, Homo sapiens
gctgactgtacttaacat

SEQ ID NO: 2567 - DNA, 18 bp, Homo sapiens
aaaataaaggtgtggctg

SEQ ID NO: 2568 - DNA, 18 bp, Homo sapiens
aataaaggtgtggctggg

SEQ ID NO: 2569 - DNA, 18 bp, Homo sapiens
taaaggtgtggctgggtg

SEQ ID NO: 2570 - DNA, 18 bp, Homo sapiens
aaggtgtggctgggtgtg

SEQ ID NO: 2571 - DNA, 18 bp, Homo sapiens
ggtgtggctgggtgtggt

SEQ ID NO: 2572 - DNA, 18 bp, Homo sapiens
aaaaaaaaaagggggtga

SEQ ID NO: 2573 - DNA, 18 bp, Homo sapiens
aaaaaaaagggggtgagc

SEQ ID NO: 2574 - DNA, 18 bp, Homo sapiens
aaaaaagggggtgagcag

SEQ ID NO: 2575 - DNA, 18 bp, Homo sapiens
aaaagggggtgagcagac

SEQ ID NO: 2576 - DNA, 18 bp, Homo sapiens
aagggggtgagcagacgt

SEQ ID NO: 2577 - DNA, 18 bp, Homo sapiens
gggggtgagcagacgtgg

SEQ ID NO: 2578 - DNA, 18 bp, Homo sapiens
gggtgagcagacgtggtg

SEQ ID NO: 2579 - DNA, 18 bp, Homo sapiens
aataaaataaaagtaaag

SEQ ID NO: 2580 - DNA, 18 bp, Homo sapiens
taaaataaaagtaaaggt

SEQ ID NO: 2581 - DNA, 18 bp, Homo sapiens
aaataaaagtaaaggtat

SEQ ID NO: 2582 - DNA, 18 bp, Homo sapiens
ataaaagtaaaggtatta

SEQ ID NO: 2583 - DNA, 18 bp, Homo sapiens
caacagacattactgttt

SEQ ID NO: 2584 - DNA, 18 bp, Homo sapiens
acagacattactgttttt

SEQ ID NO: 2585 - DNA, 18 bp, Homo sapiens
agacattactgtttttgc

SEQ ID NO: 2586 - DNA, 18 bp, Homo sapiens
acattactgtttttgctt

SEQ ID NO: 2587 - DNA, 18 bp, Homo sapiens
agggtggcgtgggcttaa

SEQ ID NO: 2588 - DNA, 18 bp, Homo sapiens
ggtggcgtgggcttaagc

SEQ ID NO: 2589 - DNA, 18 bp, Homo sapiens
tggcgtgggcttaagcag

SEQ ID NO: 2590 - DNA, 18 bp, Homo sapiens
gcgtgggcttaagcagtt

SEQ ID NO: 2591 - DNA, 18 bp, Homo sapiens
gtgggcttaagcagttgc

SEQ ID NO: 2592 - DNA, 18 bp, Homo sapiens
gggcttaagcagttgcca

SEQ ID NO: 2593 - DNA, 18 bp, Homo sapiens
gcttaagcagttgccaga

SEQ ID NO: 2594 - DNA, 18 bp, Homo sapiens
ttaagcagttgccagacg

SEQ ID NO: 2595 - DNA, 18 bp, Homo sapiens
aagcagttgccagacgtt

SEQ ID NO: 2596 - DNA, 18 bp, Homo sapiens
gcagttgccagacgttcc

SEQ ID NO: 2597 - DNA, 18 bp, Homo sapiens
agttgccagacgttcctt

SEQ ID NO: 2598 - DNA, 18 bp, Homo sapiens
ttgccagacgttccttgg

SEQ ID NO: 2599 - DNA, 18 bp, Homo sapiens
gccagacgttccttggta

SEQ ID NO: 2600 - DNA, 18 bp, Homo sapiens
cagacgttccttggtact

SEQ ID NO: 2601 - DNA, 18 bp, Homo sapiens
gacgttccttggtacttt

SEQ ID NO: 2602 - DNA, 18 bp, Homo sapiens
cgttccttggtactttgc

SEQ ID NO: 2603 - DNA, 18 bp, Homo sapiens
ttccttggtactttgcag

SEQ ID NO: 2604 - DNA, 18 bp, Homo sapiens
tgtggaccctggtgagct

SEQ ID NO: 2605 - DNA, 18 bp, Homo sapiens
tggaccctggtgagctgg

SEQ ID NO: 2606 - DNA, 18 bp, Homo sapiens
gaccctggtgagctgggt

SEQ ID NO: 2607 - DNA, 18 bp, Homo sapiens
ccctggtgagctgggtgg

SEQ ID NO: 2608 - DNA, 18 bp, Homo sapiens
ctggtgagctgggtggcc

SEQ ID NO: 2609 - DNA, 18 bp, Homo sapiens
ggtgagctgggtggcctt

SEQ ID NO: 2610 - DNA, 18 bp, Homo sapiens
tgagctgggtggccttaa

SEQ ID NO: 2611 - DNA, 18 bp, Homo sapiens
agctgggtggccttaaca

SEQ ID NO: 2612 - DNA, 18 bp, Homo sapiens
ctgggtggccttaacagc

SEQ ID NO: 2613 - DNA, 18 bp, Homo sapiens
gggtggccttaacagcag

SEQ ID NO: 2614 - DNA, 18 bp, Homo sapiens
gtggccttaacagcaggg

SEQ ID NO: 2615 - DNA, 18 bp, Homo sapiens
ggccttaacagcagggct

SEQ ID NO: 2616 - DNA, 18 bp, Homo sapiens
ccttaacagcagggctgg

SEQ ID NO: 2617 - DNA, 18 bp, Homo sapiens
ttaacagcagggctggtg

SEQ ID NO: 2618 - DNA, 18 bp, Homo sapiens
aacagcagggctggtggc

SEQ ID NO: 2619 - DNA, 18 bp, Homo sapiens
cagcagggctggtggctg

SEQ ID NO: 2620 - DNA, 18 bp, Homo sapiens
gcagggctggtggctgga

SEQ ID NO: 2621 - DNA, 18 bp, Homo sapiens
agggctggtggctggaac

SEQ ID NO: 2622 - DNA, 18 bp, Homo sapiens
ggctggtggctggaacgc

SEQ ID NO: 2623 - DNA, 18 bp, Homo sapiens
ctggtggctggaacgcgg

SEQ ID NO: 2624 - DNA, 18 bp, Homo sapiens
ggtggctggaacgcggtg

SEQ ID NO: 2625 - DNA, 18 bp, Homo sapiens
tggctggaacgcggtgcc

SEQ ID NO: 2626 - DNA, 18 bp, Homo sapiens
gctggaacgcggtgccca

SEQ ID NO: 2627 - DNA, 18 bp, Homo sapiens
tggaacgcggtgcccaga

SEQ ID NO: 2628 - DNA, 18 bp, Homo sapiens
gaacgcggtgcccagatg

SEQ ID NO: 2629 - DNA, 18 bp, Homo sapiens
acgcggtgcccagatggt

SEQ ID NO: 2630 - DNA, 18 bp, Homo sapiens
gcggtgcccagatggtca

SEQ ID NO: 2631 - DNA, 18 bp, Homo sapiens
ggtgcccagatggtcagt

SEQ ID NO: 2632 - DNA, 18 bp, Homo sapiens
tgcccagatggtcagttc

SEQ ID NO: 2633 - DNA, 18 bp, Homo sapiens
cccagatggtcagttctg

SEQ ID NO: 2634 - DNA, 18 bp, Homo sapiens
cagatggtcagttctgcc

SEQ ID NO: 2635 - DNA, 18 bp, Homo sapiens
gatggtcagttctgccct

SEQ ID NO: 2636 - DNA, 18 bp, Homo sapiens
tggtcagttctgccctgt

SEQ ID NO: 2637 - DNA, 18 bp, Homo sapiens
gtcagttctgccctgtgg

SEQ ID NO: 2638 - DNA, 18 bp, Homo sapiens
cagttctgccctgtggcc

SEQ ID NO: 2639 - DNA, 18 bp, Homo sapiens
gttctgccctgtggcctg

SEQ ID NO: 2640 - DNA, 18 bp, Homo sapiens
tctgccctgtggcctgct

SEQ ID NO: 2641 - DNA, 18 bp, Homo sapiens
tgccctgtggcctgctgc

SEQ ID NO: 2642 - DNA, 18 bp, Homo sapiens
ccctgtggcctgctgcct

SEQ ID NO: 2643 - DNA, 18 bp, Homo sapiens
ctgtggcctgctgcctgg

SEQ ID NO: 2644 - DNA, 18 bp, Homo sapiens
gtggcctgctgcctggac

SEQ ID NO: 2645 - DNA, 18 bp, Homo sapiens
ggcctgctgcctggaccc

SEQ ID NO: 2646 - DNA, 18 bp, Homo sapiens
cctgctgcctggaccccg

SEQ ID NO: 2647 - DNA, 18 bp, Homo sapiens
tgctgcctggaccccgga

SEQ ID NO: 2648 - DNA, 18 bp, Homo sapiens
ctgcctggaccccggagg

SEQ ID NO: 2649 - DNA, 18 bp, Homo sapiens
gcctggaccccggaggag

SEQ ID NO: 2650 - DNA, 18 bp, Homo sapiens
ctggaccccggaggagcc

SEQ ID NO: 2651 - DNA, 18 bp, Homo sapiens
ggaccccggaggagccag

SEQ ID NO: 2652 - DNA, 18 bp, Homo sapiens
accccggaggagccagct

SEQ ID NO: 2653 - DNA, 18 bp, Homo sapiens
cccggaggagccagctac

SEQ ID NO: 2654 - DNA, 18 bp, Homo sapiens
cggaggagccagctacag

SEQ ID NO: 2655 - DNA, 18 bp, Homo sapiens
gaggagccagctacagct

SEQ ID NO: 2656 - DNA, 18 bp, Homo sapiens
ggagccagctacagctgc

SEQ ID NO: 2657 - DNA, 18 bp, Homo sapiens
agccagctacagctgctg

SEQ ID NO: 2658 - DNA, 18 bp, Homo sapiens
ccagctacagctgctgcc

SEQ ID NO: 2659 - DNA, 18 bp, Homo sapiens
agctacagctgctgccgt

SEQ ID NO: 2660 - DNA, 18 bp, Homo sapiens
ctacagctgctgccgtcc

SEQ ID NO: 2661 - DNA, 18 bp, Homo sapiens
acagctgctgccgtcccc

SEQ ID NO: 2662 - DNA, 18 bp, Homo sapiens
agctgctgccgtcccctt

SEQ ID NO: 2663 - DNA, 18 bp, Homo sapiens
ctgctgccgtccccttct

SEQ ID NO: 2664 - DNA, 18 bp, Homo sapiens
gctgccgtccccttctgg

SEQ ID NO: 2665 - DNA, 18 bp, Homo sapiens
tgccgtccccttctggtg

SEQ ID NO: 2666 - DNA, 18 bp, Homo sapiens
ccgtccccttctggtgag

SEQ ID NO: 2667 - DNA, 18 bp, Homo sapiens
gtccccttctggtgagtg

SEQ ID NO: 2668 - DNA, 18 bp, Homo sapiens
ccccttctggtgagtgcc

SEQ ID NO: 2669 - DNA, 18 bp, Homo sapiens
ccttctggtgagtgcccc

SEQ ID NO: 2670 - DNA, 18 bp, Homo sapiens
ttctggtgagtgcccctc

SEQ ID NO: 2671 - DNA, 18 bp, Homo sapiens
ctggtgagtgcccctcag

SEQ ID NO: 2672 - DNA, 18 bp, Homo sapiens
ggtgagtgcccctcagcc

SEQ ID NO: 2673 - DNA, 18 bp, Homo sapiens
tgagtgcccctcagccta

SEQ ID NO: 2674 - DNA, 18 bp, Homo sapiens
agtgcccctcagcctagg

SEQ ID NO: 2675 - DNA, 18 bp, Homo sapiens
tgcccctcagcctaggca

SEQ ID NO: 2676 - DNA, 18 bp, Homo sapiens
cccctcagcctaggcaag

SEQ ID NO: 2677 - DNA, 18 bp, Homo sapiens
cctcagcctaggcaagag

SEQ ID NO: 2678 - DNA, 18 bp, Homo sapiens
tcagcctaggcaagagct

SEQ ID NO: 2679 - DNA, 18 bp, Homo sapiens
agcctaggcaagagctgg

SEQ ID NO: 2680 - DNA, 18 bp, Homo sapiens
cctaggcaagagctggca

SEQ ID NO: 2681 - DNA, 18 bp, Homo sapiens
taggcaagagctggcagc

SEQ ID NO: 2682 - DNA, 18 bp, Homo sapiens
ggcaagagctggcagcct

SEQ ID NO: 2683 - DNA, 18 bp, Homo sapiens
caagagctggcagcctgg

SEQ ID NO: 2684 - DNA, 18 bp, Homo sapiens
agagctggcagcctgggt

SEQ ID NO: 2685 - DNA, 18 bp, Homo sapiens
agctggcagcctgggttt

SEQ ID NO: 2686 - DNA, 18 bp, Homo sapiens
ctggcagcctgggttttc

SEQ ID NO: 2687 - DNA, 18 bp, Homo sapiens
ggcagcctgggttttccc

SEQ ID NO: 2688 - DNA, 18 bp, Homo sapiens
cagcctgggttttcccaa

SEQ ID NO: 2689 - DNA, 18 bp, Homo sapiens
gcctgggttttcccaaag

SEQ ID NO: 2690 - DNA, 18 bp, Homo sapiens
gaggacgccaggcacaag

SEQ ID NO: 2691 - DNA, 18 bp, Homo sapiens
ggacgccaggcacaagtc

SEQ ID NO: 2692 - DNA, 18 bp, Homo sapiens
acgccaggcacaagtctg

SEQ ID NO: 2693 - DNA, 18 bp, Homo sapiens
gccaggcacaagtctgtg

SEQ ID NO: 2694 - DNA, 18 bp, Homo sapiens
caggcacaagtctgtggt

SEQ ID NO: 2695 - DNA, 18 bp, Homo sapiens
ggcacaagtctgtggttt

SEQ ID NO: 2696 - DNA, 18 bp, Homo sapiens
cacaagtctgtggtttat

SEQ ID NO: 2697 - DNA, 18 bp, Homo sapiens
caagtctgtggtttatca

SEQ ID NO: 2698 - DNA, 18 bp, Homo sapiens
agtctgtggtttatcatt

SEQ ID NO: 2699 - DNA, 18 bp, Homo sapiens
tctgtggtttatcatttt

SEQ ID NO: 2700 - DNA, 18 bp, Homo sapiens
tgtggtttatcattttcc

SEQ ID NO: 2701 - DNA, 18 bp, Homo sapiens
tggtttatcattttccct

SEQ ID NO: 2702 - DNA, 18 bp, Homo sapiens
gtttatcattttccctgt

SEQ ID NO: 2703 - DNA, 18 bp, Homo sapiens
ttatcattttccctgtct

SEQ ID NO: 2704 - DNA, 18 bp, Homo sapiens
atcattttccctgtcttt

SEQ ID NO: 2705 - DNA, 18 bp, Homo sapiens
cattttccctgtctttct

SEQ ID NO: 2706 - DNA, 18 bp, Homo sapiens
ttttccctgtctttctag

SEQ ID NO: 2707 - DNA, 18 bp, Homo sapiens
ttccctgtctttctagga

SEQ ID NO: 2708 - DNA, 18 bp, Homo sapiens
ccctgtctttctaggaca

SEQ ID NO: 2709 - DNA, 18 bp, Homo sapiens
ctgtctttctaggacaaa

SEQ ID NO: 2710 - DNA, 18 bp, Homo sapiens
gtctttctaggacaaatg

SEQ ID NO: 2711 - DNA, 18 bp, Homo sapiens
ctttctaggacaaatggc

SEQ ID NO: 2712 - DNA, 18 bp, Homo sapiens
ttctaggacaaatggccc

SEQ ID NO: 2713 - DNA, 18 bp, Homo sapiens
ctaggacaaatggcccac

SEQ ID NO: 2714 - DNA, 18 bp, Homo sapiens
aggacaaatggcccacaa

SEQ ID NO: 2715 - DNA, 18 bp, Homo sapiens
gacaaatggcccacaaca

SEQ ID NO: 2716 - DNA, 18 bp, Homo sapiens
caaatggcccacaacact

SEQ ID NO: 2717 - DNA, 18 bp, Homo sapiens
aatggcccacaacactga

SEQ ID NO: 2718 - DNA, 18 bp, Homo sapiens
tggcccacaacactgagc

SEQ ID NO: 2719 - DNA, 18 bp, Homo sapiens
gcccacaacactgagcag

SEQ ID NO: 2720 - DNA, 18 bp, Homo sapiens
ccacaacactgagcaggc

SEQ ID NO: 2721 - DNA, 18 bp, Homo sapiens
acaacactgagcaggcat

SEQ ID NO: 2722 - DNA, 18 bp, Homo sapiens
aacactgagcaggcatct

SEQ ID NO: 2723 - DNA, 18 bp, Homo sapiens
cactgagcaggcatctgg

SEQ ID NO: 2724 - DNA, 18 bp, Homo sapiens
ctgagcaggcatctgggt

SEQ ID NO: 2725 - DNA, 18 bp, Homo sapiens
gagcaggcatctgggtgg

SEQ ID NO: 2726 - DNA, 18 bp, Homo sapiens
gcaggcatctgggtggcc

SEQ ID NO: 2727 - DNA, 18 bp, Homo sapiens
aggcatctgggtggcccc

SEQ ID NO: 2728 - DNA, 18 bp, Homo sapiens
gcatctgggtggcccctg

SEQ ID NO: 2729 - DNA, 18 bp, Homo sapiens
atctgggtggcccctgcc

SEQ ID NO: 2730 - DNA, 18 bp, Homo sapiens
ctgggtggcccctgccag

SEQ ID NO: 2731 - DNA, 18 bp, Homo sapiens
gggtggcccctgccaggt

SEQ ID NO: 2732 - DNA, 18 bp, Homo sapiens
gtggcccctgccaggttg

SEQ ID NO: 2733 - DNA, 18 bp, Homo sapiens
ggcccctgccaggttgat

SEQ ID NO: 2734 - DNA, 18 bp, Homo sapiens
cccctgccaggttgatgc

SEQ ID NO: 2735 - DNA, 18 bp, Homo sapiens
cctgccaggttgatgccc

SEQ ID NO: 2736 - DNA, 18 bp, Homo sapiens
tgccaggttgatgcccac

SEQ ID NO: 2737 - DNA, 18 bp, Homo sapiens
ccaggttgatgcccactg

SEQ ID NO: 2738 - DNA, 18 bp, Homo sapiens
aggttgatgcccactgct

SEQ ID NO: 2739 - DNA, 18 bp, Homo sapiens
gttgatgcccactgctct

SEQ ID NO: 2740 - DNA, 18 bp, Homo sapiens
tgatgcccactgctctgc

SEQ ID NO: 2741 - DNA, 18 bp, Homo sapiens
atgcccactgctctgccg

SEQ ID NO: 2742 - DNA, 18 bp, Homo sapiens
gcccactgctctgccggc

SEQ ID NO: 2743 - DNA, 18 bp, Homo sapiens
ccactgctctgccggcca

SEQ ID NO: 2744 - DNA, 18 bp, Homo sapiens
actgctctgccggccact

SEQ ID NO: 2745 - DNA, 18 bp, Homo sapiens
tgctctgccggccactcc

SEQ ID NO: 2746 - DNA, 18 bp, Homo sapiens
ctctgccggccactcctg

SEQ ID NO: 2747 - DNA, 18 bp, Homo sapiens
ctgccggccactcctgca

SEQ ID NO: 2748 - DNA, 18 bp, Homo sapiens
gccggccactcctgcatc

SEQ ID NO: 2749 - DNA, 18 bp, Homo sapiens
cggccactcctgcatctt

SEQ ID NO: 2750 - DNA, 18 bp, Homo sapiens
gccactcctgcatcttta

SEQ ID NO: 2751 - DNA, 18 bp, Homo sapiens
cactcctgcatctttacc

SEQ ID NO: 2752 - DNA, 18 bp, Homo sapiens
ctcctgcatctttaccgt

SEQ ID NO: 2753 - DNA, 18 bp, Homo sapiens
cctgcatctttaccgtct

SEQ ID NO: 2754 - DNA, 18 bp, Homo sapiens
tgcatctttaccgtctca

SEQ ID NO: 2755 - DNA, 18 bp, Homo sapiens
catctttaccgtctcagg

SEQ ID NO: 2756 - DNA, 18 bp, Homo sapiens
tctttaccgtctcaggga

SEQ ID NO: 2757 - DNA, 18 bp, Homo sapiens
tttaccgtctcagggact

SEQ ID NO: 2758 - DNA, 18 bp, Homo sapiens
taccgtctcagggacttc

SEQ ID NO: 2759 - DNA, 18 bp, Homo sapiens
ccgtctcagggacttcca

SEQ ID NO: 2760 - DNA, 18 bp, Homo sapiens
gtctcagggacttccagt

SEQ ID NO: 2761 - DNA, 18 bp, Homo sapiens
ctcagggacttccagttg

SEQ ID NO: 2762 - DNA, 18 bp, Homo sapiens
cagggacttccagttgct

SEQ ID NO: 2763 - DNA, 18 bp, Homo sapiens
gggacttccagttgctgc

SEQ ID NO: 2764 - DNA, 18 bp, Homo sapiens
gacttccagttgctgccc

SEQ ID NO: 2765 - DNA, 18 bp, Homo sapiens
cttccagttgctgcccct

SEQ ID NO: 2766 - DNA, 18 bp, Homo sapiens
tccagttgctgccccttc

SEQ ID NO: 2767 - DNA, 18 bp, Homo sapiens
cagttgctgccccttccc

SEQ ID NO: 2768 - DNA, 18 bp, Homo sapiens
gttgctgccccttcccag

SEQ ID NO: 2769 - DNA, 18 bp, Homo sapiens
tgctgccccttcccagag

SEQ ID NO: 2770 - DNA, 18 bp, Homo sapiens
ctgccccttcccagaggt

SEQ ID NO: 2771 - DNA, 18 bp, Homo sapiens
gccccttcccagaggtga

SEQ ID NO: 2772 - DNA, 18 bp, Homo sapiens
cccttcccagaggtgagc

SEQ ID NO: 2773 - DNA, 18 bp, Homo sapiens
cttcccagaggtgagcgt

SEQ ID NO: 2774 - DNA, 18 bp, Homo sapiens
tcccagaggtgagcgtgc

SEQ ID NO: 2775 - DNA, 18 bp, Homo sapiens
ccagaggtgagcgtgcca

SEQ ID NO: 2776 - DNA, 18 bp, Homo sapiens
agaggtgagcgtgccatc

SEQ ID NO: 2777 - DNA, 18 bp, Homo sapiens
aggtgagcgtgccatcag

SEQ ID NO: 2778 - DNA, 18 bp, Homo sapiens
gtgagcgtgccatcagcc

SEQ ID NO: 2779 - DNA, 18 bp, Homo sapiens
gagcgtgccatcagccca

SEQ ID NO: 2780 - DNA, 18 bp, Homo sapiens
gcgtgccatcagcccagt

SEQ ID NO: 2781 - DNA, 18 bp, Homo sapiens
gtgccatcagcccagtgg

SEQ ID NO: 2782 - DNA, 18 bp, Homo sapiens
gccatcagcccagtggag

SEQ ID NO: 2783 - DNA, 18 bp, Homo sapiens
catcagcccagtggaggg

SEQ ID NO: 2784 - DNA, 18 bp, Homo sapiens
tcagcccagtggaggggc

SEQ ID NO: 2785 - DNA, 18 bp, Homo sapiens
agcccagtggaggggctt

SEQ ID NO: 2786 - DNA, 18 bp, Homo sapiens
cccagtggaggggcttag

SEQ ID NO: 2787 - DNA, 18 bp, Homo sapiens
cagtggaggggcttaggt

SEQ ID NO: 2788 - DNA, 18 bp, Homo sapiens
gtggaggggcttaggtct

SEQ ID NO: 2789 - DNA, 18 bp, Homo sapiens
ggaggggcttaggtctgc

SEQ ID NO: 2790 - DNA, 18 bp, Homo sapiens
aggggcttaggtctgcat

SEQ ID NO: 2791 - DNA, 18 bp, Homo sapiens
gggcttaggtctgcattt

SEQ ID NO: 2792 - DNA, 18 bp, Homo sapiens
gcttaggtctgcatttat

SEQ ID NO: 2793 - DNA, 18 bp, Homo sapiens
ttaggtctgcatttatgc

SEQ ID NO: 2794 - DNA, 18 bp, Homo sapiens
aggtctgcatttatgctt

SEQ ID NO: 2795 - DNA, 18 bp, Homo sapiens
cacctgcagataaaaggg

SEQ ID NO: 2796 - DNA, 18 bp, Homo sapiens
cctgcagataaaagggcc

SEQ ID NO: 2797 - DNA, 18 bp, Homo sapiens
tgcagataaaagggccct

SEQ ID NO: 2798 - DNA, 18 bp, Homo sapiens
cagataaaagggccctgc

SEQ ID NO: 2799 - DNA, 18 bp, Homo sapiens
gataaaagggccctgcca

SEQ ID NO: 2800 - DNA, 18 bp, Homo sapiens
taaaagggccctgccaat

SEQ ID NO: 2801 - DNA, 18 bp, Homo sapiens
aaagggccctgccaatgc

SEQ ID NO: 2802 - DNA, 18 bp, Homo sapiens
agggccctgccaatgcag

SEQ ID NO: 2803 - DNA, 18 bp, Homo sapiens
ggccctgccaatgcaggt

SEQ ID NO: 2804 - DNA, 18 bp, Homo sapiens
ccctgccaatgcaggttt

SEQ ID NO: 2805 - DNA, 18 bp, Homo sapiens
ctgccaatgcaggtttct

SEQ ID NO: 2806 - DNA, 18 bp, Homo sapiens
gccaatgcaggtttctct

SEQ ID NO: 2807 - DNA, 18 bp, Homo sapiens
caatgcaggtttctctgt

SEQ ID NO: 2808 - DNA, 18 bp, Homo sapiens
atgcaggtttctctgtgt

SEQ ID NO: 2809 - DNA, 18 bp, Homo sapiens
gcaggtttctctgtgttc

SEQ ID NO: 2810 - DNA, 18 bp, Homo sapiens
aggtttctctgtgttcca

SEQ ID NO: 2811 - DNA, 18 bp, Homo sapiens
gtttctctgtgttccaca

SEQ ID NO: 2812 - DNA, 18 bp, Homo sapiens
ttctctgtgttccacagg

SEQ ID NO: 2813 - DNA, 18 bp, Homo sapiens
ctctgtgttccacaggcc

SEQ ID NO: 2814 - DNA, 18 bp, Homo sapiens
ctgtgttccacaggccgt

SEQ ID NO: 2815 - DNA, 18 bp, Homo sapiens
gtgttccacaggccgtgg

SEQ ID NO: 2816 - DNA, 18 bp, Homo sapiens
gttccacaggccgtggca

SEQ ID NO: 2817 - DNA, 18 bp, Homo sapiens
tccacaggccgtggcatg

SEQ ID NO: 2818 - DNA, 18 bp, Homo sapiens
cacaggccgtggcatgcg

SEQ ID NO: 2819 - DNA, 18 bp, Homo sapiens
caggccgtggcatgcggg

SEQ ID NO: 2820 - DNA, 18 bp, Homo sapiens
ggccgtggcatgcgggga

SEQ ID NO: 2821 - DNA, 18 bp, Homo sapiens
ccgtggcatgcggggatg

SEQ ID NO: 2822 - DNA, 18 bp, Homo sapiens
gtggcatgcggggatggc

SEQ ID NO: 2823 - DNA, 18 bp, Homo sapiens
ggcatgcggggatggcca

SEQ ID NO: 2824 - DNA, 18 bp, Homo sapiens
catgcggggatggccatc

SEQ ID NO: 2825 - DNA, 18 bp, Homo sapiens
tgcggggatggccatcac

SEQ ID NO: 2826 - DNA, 18 bp, Homo sapiens
cggggatggccatcactg

SEQ ID NO: 2827 - DNA, 18 bp, Homo sapiens
gggatggccatcactgct

SEQ ID NO: 2828 - DNA, 18 bp, Homo sapiens
gatggccatcactgctgc

SEQ ID NO: 2829 - DNA, 18 bp, Homo sapiens
tggccatcactgctgccc

SEQ ID NO: 2830 - DNA, 18 bp, Homo sapiens
gccatcactgctgcccac

SEQ ID NO: 2831 - DNA, 18 bp, Homo sapiens
catcactgctgcccacgg

SEQ ID NO: 2832 - DNA, 18 bp, Homo sapiens
tcactgctgcccacgggg

SEQ ID NO: 2833 - DNA, 18 bp, Homo sapiens
actgctgcccacggggct

SEQ ID NO: 2834 - DNA, 18 bp, Homo sapiens
tgctgcccacggggcttc

SEQ ID NO: 2835 - DNA, 18 bp, Homo sapiens
ctgcccacggggcttcca

SEQ ID NO: 2836 - DNA, 18 bp, Homo sapiens
gcccacggggcttccact

SEQ ID NO: 2837 - DNA, 18 bp, Homo sapiens
ccacggggcttccactgc

SEQ ID NO: 2838 - DNA, 18 bp, Homo sapiens
acggggcttccactgcag

SEQ ID NO: 2839 - DNA, 18 bp, Homo sapiens
ggggcttccactgcagtg

SEQ ID NO: 2840 - DNA, 18 bp, Homo sapiens
ggcttccactgcagtgca

SEQ ID NO: 2841 - DNA, 18 bp, Homo sapiens
cttccactgcagtgcaga

SEQ ID NO: 2842 - DNA, 18 bp, Homo sapiens
tccactgcagtgcagacg

SEQ ID NO: 2843 - DNA, 18 bp, Homo sapiens
cactgcagtgcagacggg

SEQ ID NO: 2844 - DNA, 18 bp, Homo sapiens
ctgcagtgcagacgggcg

SEQ ID NO: 2845 - DNA, 18 bp, Homo sapiens
gcagtgcagacgggcgat

SEQ ID NO: 2846 - DNA, 18 bp, Homo sapiens
agtgcagacgggcgatcc

SEQ ID NO: 2847 - DNA, 18 bp, Homo sapiens
tgcagacgggcgatcctg

SEQ ID NO: 2848 - DNA, 18 bp, Homo sapiens
cagacgggcgatcctgct

SEQ ID NO: 2849 - DNA, 18 bp, Homo sapiens
gacgggcgatcctgcttc

SEQ ID NO: 2850 - DNA, 18 bp, Homo sapiens
cgggcgatcctgcttcca

SEQ ID NO: 2851 - DNA, 18 bp, Homo sapiens
ggcgatcctgcttccaaa

SEQ ID NO: 2852 - DNA, 18 bp, Homo sapiens
cgatcctgcttccaaaga

SEQ ID NO: 2853 - DNA, 18 bp, Homo sapiens
atcctgcttccaaagatc

SEQ ID NO: 2854 - DNA, 18 bp, Homo sapiens
cctgcttccaaagatcag

SEQ ID NO: 2855 - DNA, 18 bp, Homo sapiens
tgcagctggggtgtgggt

SEQ ID NO: 2856 - DNA, 18 bp, Homo sapiens
cagctggggtgtgggtgc

SEQ ID NO: 2857 - DNA, 18 bp, Homo sapiens
gctggggtgtgggtgcag

SEQ ID NO: 2858 - DNA, 18 bp, Homo sapiens
tggggtgtgggtgcaggg

SEQ ID NO: 2859 - DNA, 18 bp, Homo sapiens
gggtgtgggtgcagggca

SEQ ID NO: 2860 - DNA, 18 bp, Homo sapiens
gtgtgggtgcagggcagg

SEQ ID NO: 2861 - DNA, 18 bp, Homo sapiens
gtgggtgcagggcaggca

SEQ ID NO: 2862 - DNA, 18 bp, Homo sapiens
gggtgcagggcaggcaga

SEQ ID NO: 2863 - DNA, 18 bp, Homo sapiens
gtgcagggcaggcagacg

SEQ ID NO: 2864 - DNA, 18 bp, Homo sapiens
gcagggcaggcagacggg

SEQ ID NO: 2865 - DNA, 18 bp, Homo sapiens
agggcaggcagacgggca

SEQ ID NO: 2866 - DNA, 18 bp, Homo sapiens
ggcaggcagacgggcagc

SEQ ID NO: 2867 - DNA, 18 bp, Homo sapiens
caggcagacgggcagcat

SEQ ID NO: 2868 - DNA, 18 bp, Homo sapiens
cagacgggcagcatgtgg

SEQ ID NO: 2869 - DNA, 18 bp, Homo sapiens
gacgggcagcatgtggag

SEQ ID NO: 2870 - DNA, 18 bp, Homo sapiens
cgggcagcatgtggagtc

SEQ ID NO: 2871 - DNA, 18 bp, Homo sapiens
gtcaccttccctgagtgg

SEQ ID NO: 2872 - DNA, 18 bp, Homo sapiens
caccttccctgagtgggc

SEQ ID NO: 2873 - DNA, 18 bp, Homo sapiens
ccttccctgagtgggctg

SEQ ID NO: 2874 - DNA, 18 bp, Homo sapiens
ttccctgagtgggctggt

SEQ ID NO: 2875 - DNA, 18 bp, Homo sapiens
ccctgagtgggctggtag

SEQ ID NO: 2876 - DNA, 18 bp, Homo sapiens
ctgagtgggctggtagta

SEQ ID NO: 2877 - DNA, 18 bp, Homo sapiens
gagtgggctggtagtatc

SEQ ID NO: 2878 - DNA, 18 bp, Homo sapiens
gtgggctggtagtatcct

SEQ ID NO: 2879 - DNA, 18 bp, Homo sapiens
gggctggtagtatcctgg

SEQ ID NO: 2880 - DNA, 18 bp, Homo sapiens
gctggtagtatcctgggt

SEQ ID NO: 2881 - DNA, 18 bp, Homo sapiens
tggtagtatcctgggtca

SEQ ID NO: 2882 - DNA, 18 bp, Homo sapiens
gtagtatcctgggtcatc

SEQ ID NO: 2883 - DNA, 18 bp, Homo sapiens
agtatcctgggtcatctt

SEQ ID NO: 2884 - DNA, 18 bp, Homo sapiens
tatcctgggtcatcttgt

SEQ ID NO: 2885 - DNA, 18 bp, Homo sapiens
tcctgggtcatcttgtcc

SEQ ID NO: 2886 - DNA, 18 bp, Homo sapiens
ctgggtcatcttgtccac

SEQ ID NO: 2887 - DNA, 18 bp, Homo sapiens
gggtcatcttgtccacag

SEQ ID NO: 2888 - DNA, 18 bp, Homo sapiens
gtcatcttgtccacaggt

SEQ ID NO: 2889 - DNA, 18 bp, Homo sapiens
catcttgtccacaggtaa

SEQ ID NO: 2890 - DNA, 18 bp, Homo sapiens
tcttgtccacaggtaaca

SEQ ID NO: 2891 - DNA, 18 bp, Homo sapiens
ttgtccacaggtaacaac

SEQ ID NO: 2892 - DNA, 18 bp, Homo sapiens
gtccacaggtaacaactc

SEQ ID NO: 2893 - DNA, 18 bp, Homo sapiens
ccacaggtaacaactccg

SEQ ID NO: 2894 - DNA, 18 bp, Homo sapiens
acaggtaacaactccgtg

SEQ ID NO: 2895 - DNA, 18 bp, Homo sapiens
aggtaacaactccgtggg

SEQ ID NO: 2896 - DNA, 18 bp, Homo sapiens
gtaacaactccgtgggtg

SEQ ID NO: 2897 - DNA, 18 bp, Homo sapiens
aacaactccgtgggtgcc

SEQ ID NO: 2898 - DNA, 18 bp, Homo sapiens
caactccgtgggtgccat

SEQ ID NO: 2899 - DNA, 18 bp, Homo sapiens
actccgtgggtgccatcc

SEQ ID NO: 2900 - DNA, 18 bp, Homo sapiens
tccgtgggtgccatccag

SEQ ID NO: 2901 - DNA, 18 bp, Homo sapiens
cgtgggtgccatccagtg

SEQ ID NO: 2902 - DNA, 18 bp, Homo sapiens
tgggtgccatccagtgcc

SEQ ID NO: 2903 - DNA, 18 bp, Homo sapiens
ggtgccatccagtgccct

SEQ ID NO: 2904 - DNA, 18 bp, Homo sapiens
tgccatccagtgccctga

SEQ ID NO: 2905 - DNA, 18 bp, Homo sapiens
ccatccagtgccctgata

SEQ ID NO: 2906 - DNA, 18 bp, Homo sapiens
atccagtgccctgatagt

SEQ ID NO: 2907 - DNA, 18 bp, Homo sapiens
ccagtgccctgatagtca

SEQ ID NO: 2908 - DNA, 18 bp, Homo sapiens
agtgccctgatagtcagt

SEQ ID NO: 2909 - DNA, 18 bp, Homo sapiens
tgccctgatagtcagttc

SEQ ID NO: 2910 - DNA, 18 bp, Homo sapiens
ccctgatagtcagttcga

SEQ ID NO: 2911 - DNA, 18 bp, Homo sapiens
ctgatagtcagttcgaat

SEQ ID NO: 2912 - DNA, 18 bp, Homo sapiens
gatagtcagttcgaatgc

SEQ ID NO: 2913 - DNA, 18 bp, Homo sapiens
tagtcagttcgaatgccc

SEQ ID NO: 2914 - DNA, 18 bp, Homo sapiens
gtcagttcgaatgcccgg

SEQ ID NO: 2915 - DNA, 18 bp, Homo sapiens
cagttcgaatgcccggac

SEQ ID NO: 2916 - DNA, 18 bp, Homo sapiens
gttcgaatgcccggactt

SEQ ID NO: 2917 - DNA, 18 bp, Homo sapiens
tcgaatgcccggacttct

SEQ ID NO: 2918 - DNA, 18 bp, Homo sapiens
gaatgcccggacttctcc

SEQ ID NO: 2919 - DNA, 18 bp, Homo sapiens
atgcccggacttctccac

SEQ ID NO: 2920 - DNA, 18 bp, Homo sapiens
gcccggacttctccacgt

SEQ ID NO: 2921 - DNA, 18 bp, Homo sapiens
ccggacttctccacgtgc

SEQ ID NO: 2922 - DNA, 18 bp, Homo sapiens
ggacttctccacgtgctg

SEQ ID NO: 2923 - DNA, 18 bp, Homo sapiens
acttctccacgtgctgtg

SEQ ID NO: 2924 - DNA, 18 bp, Homo sapiens
ttctccacgtgctgtgtt

SEQ ID NO: 2925 - DNA, 18 bp, Homo sapiens
ctccacgtgctgtgttat

SEQ ID NO: 2926 - DNA, 18 bp, Homo sapiens
ccacgtgctgtgttatgg

SEQ ID NO: 2927 - DNA, 18 bp, Homo sapiens
acgtgctgtgttatggtc

SEQ ID NO: 2928 - DNA, 18 bp, Homo sapiens
gtgctgtgttatggtcga

SEQ ID NO: 2929 - DNA, 18 bp, Homo sapiens
gctgtgttatggtcgatg

SEQ ID NO: 2930 - DNA, 18 bp, Homo sapiens
tgtgttatggtcgatggc

SEQ ID NO: 2931 - DNA, 18 bp, Homo sapiens
tgttatggtcgatggctc

SEQ ID NO: 2932 - DNA, 18 bp, Homo sapiens
ttatggtcgatggctcct

SEQ ID NO: 2933 - DNA, 18 bp, Homo sapiens
atggtcgatggctcctgg

SEQ ID NO: 2934 - DNA, 18 bp, Homo sapiens
ggtcgatggctcctgggg

SEQ ID NO: 2935 - DNA, 18 bp, Homo sapiens
tcgatggctcctgggggt

SEQ ID NO: 2936 - DNA, 18 bp, Homo sapiens
gatggctcctgggggtgc

SEQ ID NO: 2937 - DNA, 18 bp, Homo sapiens
tggctcctgggggtgctg

SEQ ID NO: 2938 - DNA, 18 bp, Homo sapiens
gctcctgggggtgctgcc

SEQ ID NO: 2939 - DNA, 18 bp, Homo sapiens
tcctgggggtgctgcccc

SEQ ID NO: 2940 - DNA, 18 bp, Homo sapiens
ctgggggtgctgccccat

SEQ ID NO: 2941 - DNA, 18 bp, Homo sapiens
gggggtgctgccccatgc

SEQ ID NO: 2942 - DNA, 18 bp, Homo sapiens
gggtgctgccccatgccc

SEQ ID NO: 2943 - DNA, 18 bp, Homo sapiens
gtgctgccccatgcccca

SEQ ID NO: 2944 - DNA, 18 bp, Homo sapiens
gtacaaatctgggggaga

SEQ ID NO: 2945 - DNA, 18 bp, Homo sapiens
acaaatctgggggagatg

SEQ ID NO: 2946 - DNA, 18 bp, Homo sapiens
aaatctgggggagatggg

SEQ ID NO: 2947 - DNA, 18 bp, Homo sapiens
atctgggggagatggggg

SEQ ID NO: 2948 - DNA, 18 bp, Homo sapiens
ctgggggagatgggggta

SEQ ID NO: 2949 - DNA, 18 bp, Homo sapiens
gggggagatgggggtatg

SEQ ID NO: 2950 - DNA, 18 bp, Homo sapiens
gggagatgggggtatgtg

SEQ ID NO: 2951 - DNA, 18 bp, Homo sapiens
gagatgggggtatgtgga

SEQ ID NO: 2952 - DNA, 18 bp, Homo sapiens
gatgggggtatgtggagg

SEQ ID NO: 2953 - DNA, 18 bp, Homo sapiens
tgggggtatgtggaggga

SEQ ID NO: 2954 - DNA, 18 bp, Homo sapiens
ggggtatgtggagggaag

SEQ ID NO: 2955 - DNA, 18 bp, Homo sapiens
ggtatgtggagggaagtg

SEQ ID NO: 2956 - DNA, 18 bp, Homo sapiens
tatgtggagggaagtggg

SEQ ID NO: 2957 - DNA, 18 bp, Homo sapiens
tgtggagggaagtggggg

SEQ ID NO: 2958 - DNA, 18 bp, Homo sapiens
tggagggaagtgggggca

SEQ ID NO: 2959 - DNA, 18 bp, Homo sapiens
gagggaagtgggggcaga

SEQ ID NO: 2960 - DNA, 18 bp, Homo sapiens
gggaagtgggggcagagt

SEQ ID NO: 2961 - DNA, 18 bp, Homo sapiens
tgggggccaggggcaggg

SEQ ID NO: 2962 - DNA, 18 bp, Homo sapiens
ggggccaggggcaggggg

SEQ ID NO: 2963 - DNA, 18 bp, Homo sapiens
ggccaggggcagggggtg

SEQ ID NO: 2964 - DNA, 18 bp, Homo sapiens
ccaggggcagggggtgaa

SEQ ID NO: 2965 - DNA, 18 bp, Homo sapiens
aggggcagggggtgaaga

SEQ ID NO: 2966 - DNA, 18 bp, Homo sapiens
gggcagggggtgaagacg

SEQ ID NO: 2967 - DNA, 18 bp, Homo sapiens
gcagggggtgaagacgga

SEQ ID NO: 2968 - DNA, 18 bp, Homo sapiens
agggggtgaagacggagt

SEQ ID NO: 2969 - DNA, 18 bp, Homo sapiens
ggggtgaagacggagtca

SEQ ID NO: 2970 - DNA, 18 bp, Homo sapiens
ggtgaagacggagtcagg

SEQ ID NO: 2971 - DNA, 18 bp, Homo sapiens
tgaagacggagtcaggac

SEQ ID NO: 2972 - DNA, 18 bp, Homo sapiens
aagacggagtcaggacca

SEQ ID NO: 2973 - DNA, 18 bp, Homo sapiens
gacggagtcaggaccatt

SEQ ID NO: 2974 - DNA, 18 bp, Homo sapiens
cggagtcaggaccatttt

SEQ ID NO: 2975 - DNA, 18 bp, Homo sapiens
gagtcaggaccatttttt

SEQ ID NO: 2976 - DNA, 18 bp, Homo sapiens
gtcaggaccattttttct

SEQ ID NO: 2977 - DNA, 18 bp, Homo sapiens
caggaccattttttctca

SEQ ID NO: 2978 - DNA, 18 bp, Homo sapiens
gcttcctgctgtgaagac

SEQ ID NO: 2979 - DNA, 18 bp, Homo sapiens
ttcctgctgtgaagacag

SEQ ID NO: 2980 - DNA, 18 bp, Homo sapiens
cctgctgtgaagacaggg

SEQ ID NO: 2981 - DNA, 18 bp, Homo sapiens
tgctgtgaagacagggtg

SEQ ID NO: 2982 - DNA, 18 bp, Homo sapiens
ctgtgaagacagggtgca

SEQ ID NO: 2983 - DNA, 18 bp, Homo sapiens
gtgaagacagggtgcact

SEQ ID NO: 2984 - DNA, 18 bp, Homo sapiens
gaagacagggtgcactgc

SEQ ID NO: 2985 - DNA, 18 bp, Homo sapiens
agacagggtgcactgctg

SEQ ID NO: 2986 - DNA, 18 bp, Homo sapiens
acagggtgcactgctgtc

SEQ ID NO: 2987 - DNA, 18 bp, Homo sapiens
agggtgcactgctgtccg

SEQ ID NO: 2988 - DNA, 18 bp, Homo sapiens
ggtgcactgctgtccgca

SEQ ID NO: 2989 - DNA, 18 bp, Homo sapiens
tgcactgctgtccgcacg

SEQ ID NO: 2990 - DNA, 18 bp, Homo sapiens
cactgctgtccgcacggt

SEQ ID NO: 2991 - DNA, 18 bp, Homo sapiens
ctgctgtccgcacggtgc

SEQ ID NO: 2992 - DNA, 18 bp, Homo sapiens
gctgtccgcacggtgcct

SEQ ID NO: 2993 - DNA, 18 bp, Homo sapiens
tgtccgcacggtgccttc

SEQ ID NO: 2994 - DNA, 18 bp, Homo sapiens
tccgcacggtgccttctg

SEQ ID NO: 2995 - DNA, 18 bp, Homo sapiens
cgcacggtgccttctgcg

SEQ ID NO: 2996 - DNA, 18 bp, Homo sapiens
cacggtgccttctgcgac

SEQ ID NO: 2997 - DNA, 18 bp, Homo sapiens
cggtgccttctgcgacct

SEQ ID NO: 2998 - DNA, 18 bp, Homo sapiens
gtgccttctgcgacctgg

SEQ ID NO: 2999 - DNA, 18 bp, Homo sapiens
gccttctgcgacctggtt

SEQ ID NO: 3000 - DNA, 18 bp, Homo sapiens
cttctgcgacctggttca

SEQ ID NO: 3001 - DNA, 18 bp, Homo sapiens
tctgcgacctggttcaca

SEQ ID NO: 3002 - DNA, 18 bp, Homo sapiens
tgcgacctggttcacacc

SEQ ID NO: 3003 - DNA, 18 bp, Homo sapiens
cgacctggttcacacccg

SEQ ID NO: 3004 - DNA, 18 bp, Homo sapiens
acctggttcacacccgct

SEQ ID NO: 3005 - DNA, 18 bp, Homo sapiens
ctggttcacacccgctgc

SEQ ID NO: 3006 - DNA, 18 bp, Homo sapiens
ggttcacacccgctgcat

SEQ ID NO: 3007 - DNA, 18 bp, Homo sapiens
ttcacacccgctgcatca

SEQ ID NO: 3008 - DNA, 18 bp, Homo sapiens
cacacccgctgcatcaca

SEQ ID NO: 3009 - DNA, 18 bp, Homo sapiens
cacccgctgcatcacacc

SEQ ID NO: 3010 - DNA, 18 bp, Homo sapiens
cccgctgcatcacaccca

SEQ ID NO: 3011 - DNA, 18 bp, Homo sapiens
cgctgcatcacacccacg

SEQ ID NO: 3012 - DNA, 18 bp, Homo sapiens
ctgcatcacacccacggg

SEQ ID NO: 3013 - DNA, 18 bp, Homo sapiens
gcatcacacccacgggca

SEQ ID NO: 3014 - DNA, 18 bp, Homo sapiens
atcacacccacgggcacc

SEQ ID NO: 3015 - DNA, 18 bp, Homo sapiens
cacacccacgggcaccca

SEQ ID NO: 3016 - DNA, 18 bp, Homo sapiens
cacccacgggcacccacc

SEQ ID NO: 3017 - DNA, 18 bp, Homo sapiens
cccacgggcacccacccc

SEQ ID NO: 3018 - DNA, 18 bp, Homo sapiens
cacgggcacccaccccct

SEQ ID NO: 3019 - DNA, 18 bp, Homo sapiens
cgggcacccaccccctgg

SEQ ID NO: 3020 - DNA, 18 bp, Homo sapiens
ggcacccaccccctggca

SEQ ID NO: 3021 - DNA, 18 bp, Homo sapiens
cacccaccccctggcaaa

SEQ ID NO: 3022 - DNA, 18 bp, Homo sapiens
cccaccccctggcaaaga

SEQ ID NO: 3023 - DNA, 18 bp, Homo sapiens
caccccctggcaaagaag

SEQ ID NO: 3024 - DNA, 18 bp, Homo sapiens
ccccctggcaaagaagct

SEQ ID NO: 3025 - DNA, 18 bp, Homo sapiens
ccctggcaaagaagctcc

SEQ ID NO: 3026 - DNA, 18 bp, Homo sapiens
ctggcaaagaagctccct

SEQ ID NO: 3027 - DNA, 18 bp, Homo sapiens
ggcaaagaagctccctgc

SEQ ID NO: 3028 - DNA, 18 bp, Homo sapiens
caaagaagctccctgccc

SEQ ID NO: 3029 - DNA, 18 bp, Homo sapiens
aagaagctccctgcccag

SEQ ID NO: 3030 - DNA, 18 bp, Homo sapiens
gaagctccctgcccagag

SEQ ID NO: 3031 - DNA, 18 bp, Homo sapiens
agctccctgcccagagga

SEQ ID NO: 3032 - DNA, 18 bp, Homo sapiens
ctccctgcccagaggact

SEQ ID NO: 3033 - DNA, 18 bp, Homo sapiens
ccctgcccagaggactaa

SEQ ID NO: 3034 - DNA, 18 bp, Homo sapiens
ctgcccagaggactaaca

SEQ ID NO: 3035 - DNA, 18 bp, Homo sapiens
gcccagaggactaacagg

SEQ ID NO: 3036 - DNA, 18 bp, Homo sapiens
ccagaggactaacagggc

SEQ ID NO: 3037 - DNA, 18 bp, Homo sapiens
agaggactaacagggcag

SEQ ID NO: 3038 - DNA, 18 bp, Homo sapiens
aggactaacagggcaggt

SEQ ID NO: 3039 - DNA, 18 bp, Homo sapiens
gactaacagggcaggtga

SEQ ID NO: 3040 - DNA, 18 bp, Homo sapiens
ctaacagggcaggtgagg

SEQ ID NO: 3041 - DNA, 18 bp, Homo sapiens
aacagggcaggtgaggag

SEQ ID NO: 3042 - DNA, 18 bp, Homo sapiens
cagggcaggtgaggaggt

SEQ ID NO: 3043 - DNA, 18 bp, Homo sapiens
gggcaggtgaggaggtgg

SEQ ID NO: 3044 - DNA, 18 bp, Homo sapiens
gcaggtgaggaggtggga

SEQ ID NO: 3045 - DNA, 18 bp, Homo sapiens
aggtgaggaggtgggaga

SEQ ID NO: 3046 - DNA, 18 bp, Homo sapiens
gtgaggaggtgggagagc

SEQ ID NO: 3047 - DNA, 18 bp, Homo sapiens
gaggaggtgggagagcat

SEQ ID NO: 3048 - DNA, 18 bp, Homo sapiens
ggaggtgggagagcatca

SEQ ID NO: 3049 - DNA, 18 bp, Homo sapiens
aggtgggagagcatcagg

SEQ ID NO: 3050 - DNA, 18 bp, Homo sapiens
gtgggagagcatcaggcc

SEQ ID NO: 3051 - DNA, 18 bp, Homo sapiens
gggagagcatcaggccag

SEQ ID NO: 3052 - DNA, 18 bp, Homo sapiens
gagagcatcaggccaggg

SEQ ID NO: 3053 - DNA, 18 bp, Homo sapiens
gagcatcaggccaggggc

SEQ ID NO: 3054 - DNA, 18 bp, Homo sapiens
gcatcaggccaggggctg

SEQ ID NO: 3055 - DNA, 18 bp, Homo sapiens
atcaggccaggggctggg

SEQ ID NO: 3056 - DNA, 18 bp, Homo sapiens
caggccaggggctggggc

SEQ ID NO: 3057 - DNA, 18 bp, Homo sapiens
ggccaggggctggggcgg

SEQ ID NO: 3058 - DNA, 18 bp, Homo sapiens
ccaggggctggggcgggg

SEQ ID NO: 3059 - DNA, 18 bp, Homo sapiens
aggggctggggcggggcc

SEQ ID NO: 3060 - DNA, 18 bp, Homo sapiens
gggctggggcggggcctc

SEQ ID NO: 3061 - DNA, 18 bp, Homo sapiens
gctggggcggggcctcat

SEQ ID NO: 3062 - DNA, 18 bp, Homo sapiens
tggggcggggcctcattg

SEQ ID NO: 3063 - DNA, 18 bp, Homo sapiens
ggaaaaagtttcctccat

SEQ ID NO: 3064 - DNA, 18 bp, Homo sapiens
aaaaagtttcctccatcc

SEQ ID NO: 3065 - DNA, 18 bp, Homo sapiens
aaagtttcctccatcctg

SEQ ID NO: 3066 - DNA, 18 bp, Homo sapiens
agtttcctccatcctggc

SEQ ID NO: 3067 - DNA, 18 bp, Homo sapiens
tttcctccatcctggctg

SEQ ID NO: 3068 - DNA, 18 bp, Homo sapiens
tcctccatcctggctgcc

SEQ ID NO: 3069 - DNA, 18 bp, Homo sapiens
ctccatcctggctgcccc

SEQ ID NO: 3070 - DNA, 18 bp, Homo sapiens
ccatcctggctgcccctc

SEQ ID NO: 3071 - DNA, 18 bp, Homo sapiens
atcctggctgcccctcac

SEQ ID NO: 3072 - DNA, 18 bp, Homo sapiens
cctggctgcccctcacgt

SEQ ID NO: 3073 - DNA, 18 bp, Homo sapiens
tggctgcccctcacgttt

SEQ ID NO: 3074 - DNA, 18 bp, Homo sapiens
gctgcccctcacgtttgc

SEQ ID NO: 3075 - DNA, 18 bp, Homo sapiens
tgcccctcacgtttgctc

SEQ ID NO: 3076 - DNA, 18 bp, Homo sapiens
cccctcacgtttgctcct

SEQ ID NO: 3077 - DNA, 18 bp, Homo sapiens
cctcacgtttgctcctct

SEQ ID NO: 3078 - DNA, 18 bp, Homo sapiens
tcacgtttgctcctcttc

SEQ ID NO: 3079 - DNA, 18 bp, Homo sapiens
acgtttgctcctcttcca

SEQ ID NO: 3080 - DNA, 18 bp, Homo sapiens
tggccttgtccagctcgg

SEQ ID NO: 3081 - DNA, 18 bp, Homo sapiens
gccttgtccagctcggtc

SEQ ID NO: 3082 - DNA, 18 bp, Homo sapiens
cttgtccagctcggtcat

SEQ ID NO: 3083 - DNA, 18 bp, Homo sapiens
tgtccagctcggtcatgt

SEQ ID NO: 3084 - DNA, 18 bp, Homo sapiens
tccagctcggtcatgtgt

SEQ ID NO: 3085 - DNA, 18 bp, Homo sapiens
cagctcggtcatgtgtcc

SEQ ID NO: 3086 - DNA, 18 bp, Homo sapiens
gctcggtcatgtgtccgg

SEQ ID NO: 3087 - DNA, 18 bp, Homo sapiens
tcggtcatgtgtccggac

SEQ ID NO: 3088 - DNA, 18 bp, Homo sapiens
ggtcatgtgtccggacgc

SEQ ID NO: 3089 - DNA, 18 bp, Homo sapiens
tcatgtgtccggacgcac

SEQ ID NO: 3090 - DNA, 18 bp, Homo sapiens
atgtgtccggacgcacgg

SEQ ID NO: 3091 - DNA, 18 bp, Homo sapiens
gtgtccggacgcacggtc

SEQ ID NO: 3092 - DNA, 18 bp, Homo sapiens
gtccggacgcacggtccc

SEQ ID NO: 3093 - DNA, 18 bp, Homo sapiens
ccggacgcacggtcccgg

SEQ ID NO: 3094 - DNA, 18 bp, Homo sapiens
ggacgcacggtcccggtg

SEQ ID NO: 3095 - DNA, 18 bp, Homo sapiens
acgcacggtcccggtgcc

SEQ ID NO: 3096 - DNA, 18 bp, Homo sapiens
gcacggtcccggtgccct

SEQ ID NO: 3097 - DNA, 18 bp, Homo sapiens
acggtcccggtgccctga

SEQ ID NO: 3098 - DNA, 18 bp, Homo sapiens
ggtcccggtgccctgatg

SEQ ID NO: 3099 - DNA, 18 bp, Homo sapiens
tcccggtgccctgatggt

SEQ ID NO: 3100 - DNA, 18 bp, Homo sapiens
ccggtgccctgatggttc

SEQ ID NO: 3101 - DNA, 18 bp, Homo sapiens
ggtgccctgatggttcta

SEQ ID NO: 3102 - DNA, 18 bp, Homo sapiens
tgccctgatggttctacc

SEQ ID NO: 3103 - DNA, 18 bp, Homo sapiens
ccctgatggttctacctg

SEQ ID NO: 3104 - DNA, 18 bp, Homo sapiens
ctgatggttctacctgct

SEQ ID NO: 3105 - DNA, 18 bp, Homo sapiens
gatggttctacctgctgt

SEQ ID NO: 3106 - DNA, 18 bp, Homo sapiens
tggttctacctgctgtga

SEQ ID NO: 3107 - DNA, 18 bp, Homo sapiens
gttctacctgctgtgagc

SEQ ID NO: 3108 - DNA, 18 bp, Homo sapiens
tctacctgctgtgagctg

SEQ ID NO: 3109 - DNA, 18 bp, Homo sapiens
tacctgctgtgagctgcc

SEQ ID NO: 3110 - DNA, 18 bp, Homo sapiens
cctgctgtgagctgccca

SEQ ID NO: 3111 - DNA, 18 bp, Homo sapiens
tgctgtgagctgcccagt

SEQ ID NO: 3112 - DNA, 18 bp, Homo sapiens
ctgtgagctgcccagtgg

SEQ ID NO: 3113 - DNA, 18 bp, Homo sapiens
gtgagctgcccagtggga

SEQ ID NO: 3114 - DNA, 18 bp, Homo sapiens
gagctgcccagtgggaag

SEQ ID NO: 3115 - DNA, 18 bp, Homo sapiens
gctgcccagtgggaagta

SEQ ID NO: 3116 - DNA, 18 bp, Homo sapiens
tgcccagtgggaagtatg

SEQ ID NO: 3117 - DNA, 18 bp, Homo sapiens
cccagtgggaagtatggc

SEQ ID NO: 3118 - DNA, 18 bp, Homo sapiens
cagtgggaagtatggctg

SEQ ID NO: 3119 - DNA, 18 bp, Homo sapiens
gtgggaagtatggctgct

SEQ ID NO: 3120 - DNA, 18 bp, Homo sapiens
gggaagtatggctgctgc

SEQ ID NO: 3121 - DNA, 18 bp, Homo sapiens
gaagtatggctgctgccc

SEQ ID NO: 3122 - DNA, 18 bp, Homo sapiens
agtatggctgctgcccaa

SEQ ID NO: 3123 - DNA, 18 bp, Homo sapiens
tatggctgctgcccaatg

SEQ ID NO: 3124 - DNA, 18 bp, Homo sapiens
tggctgctgcccaatgcc

SEQ ID NO: 3125 - DNA, 18 bp, Homo sapiens
gctgctgcccaatgccca

SEQ ID NO: 3126 - DNA, 18 bp, Homo sapiens
tgctgcccaatgcccaac

SEQ ID NO: 3127 - DNA, 18 bp, Homo sapiens
tgagtgaggggctggagc

SEQ ID NO: 3128 - DNA, 18 bp, Homo sapiens
agtgaggggctggagcca

SEQ ID NO: 3129 - DNA, 18 bp, Homo sapiens
tgaggggctggagccagc

SEQ ID NO: 3130 - DNA, 18 bp, Homo sapiens
aggggctggagccagctt

SEQ ID NO: 3131 - DNA, 18 bp, Homo sapiens
gggctggagccagcttgg

SEQ ID NO: 3132 - DNA, 18 bp, Homo sapiens
gctggagccagcttggct

SEQ ID NO: 3133 - DNA, 18 bp, Homo sapiens
tggagccagcttggctgt

SEQ ID NO: 3134 - DNA, 18 bp, Homo sapiens
gagccagcttggctgtgt

SEQ ID NO: 3135 - DNA, 18 bp, Homo sapiens
gccagcttggctgtgtgc

SEQ ID NO: 3136 - DNA, 18 bp, Homo sapiens
cagcttggctgtgtgccc

SEQ ID NO: 3137 - DNA, 18 bp, Homo sapiens
gcttggctgtgtgccccc

SEQ ID NO: 3138 - DNA, 18 bp, Homo sapiens
ttggctgtgtgcccccag

SEQ ID NO: 3139 - DNA, 18 bp, Homo sapiens
ggctgtgtgcccccagcc

SEQ ID NO: 3140 - DNA, 18 bp, Homo sapiens
ctgtgtgcccccagccac

SEQ ID NO: 3141 - DNA, 18 bp, Homo sapiens
gtgtgcccccagccacct

SEQ ID NO: 3142 - DNA, 18 bp, Homo sapiens
gtgcccccagccacctgg

SEQ ID NO: 3143 - DNA, 18 bp, Homo sapiens
gcccccagccacctggcc

SEQ ID NO: 3144 - DNA, 18 bp, Homo sapiens
tctgtggcatggggctgg

SEQ ID NO: 3145 - DNA, 18 bp, Homo sapiens
tgtggcatggggctggct

SEQ ID NO: 3146 - DNA, 18 bp, Homo sapiens
tggcatggggctggctgg

SEQ ID NO: 3147 - DNA, 18 bp, Homo sapiens
gagcctggctgatgcagg

SEQ ID NO: 3148 - DNA, 18 bp, Homo sapiens
gcctggctgatgcagggt

SEQ ID NO: 3149 - DNA, 18 bp, Homo sapiens
ctggctgatgcagggttc

SEQ ID NO: 3150 - DNA, 18 bp, Homo sapiens
ggctgatgcagggttcat

SEQ ID NO: 3151 - DNA, 18 bp, Homo sapiens
tgtgctactgagcctgga

SEQ ID NO: 3152 - DNA, 18 bp, Homo sapiens
tgctactgagcctggaag

SEQ ID NO: 3153 - DNA, 18 bp, Homo sapiens
ctactgagcctggaagtg

SEQ ID NO: 3154 - DNA, 18 bp, Homo sapiens
actgagcctggaagtgac

SEQ ID NO: 3155 - DNA, 18 bp, Homo sapiens
tgagcctggaagtgacaa

SEQ ID NO: 3156 - DNA, 18 bp, Homo sapiens
agcctggaagtgacaaag

SEQ ID NO: 3157 - DNA, 18 bp, Homo sapiens
cctggaagtgacaaagac

SEQ ID NO: 3158 - DNA, 18 bp, Homo sapiens
tggaagtgacaaagaccc

SEQ ID NO: 3159 - DNA, 18 bp, Homo sapiens
gaagtgacaaagacccac

SEQ ID NO: 3160 - DNA, 18 bp, Homo sapiens
agtgacaaagacccaccc

SEQ ID NO: 3161 - DNA, 18 bp, Homo sapiens
tgacaaagacccacccct

SEQ ID NO: 3162 - DNA, 18 bp, Homo sapiens
acaaagacccacccctgt

SEQ ID NO: 3163 - DNA, 18 bp, Homo sapiens
aaagacccacccctgtcc

SEQ ID NO: 3164 - DNA, 18 bp, Homo sapiens
agacccacccctgtcccc

SEQ ID NO: 3165 - DNA, 18 bp, Homo sapiens
acccacccctgtccccac

SEQ ID NO: 3166 - DNA, 18 bp, Homo sapiens
ccacccctgtccccactc

SEQ ID NO: 3167 - DNA, 18 bp, Homo sapiens
acccctgtccccactcag

SEQ ID NO: 3168 - DNA, 18 bp, Homo sapiens
ccacctgctgctccgatc

SEQ ID NO: 3169 - DNA, 18 bp, Homo sapiens
acctgctgctccgatcac

SEQ ID NO: 3170 - DNA, 18 bp, Homo sapiens
ctgctgctccgatcacct

SEQ ID NO: 3171 - DNA, 18 bp, Homo sapiens
gctgctccgatcacctgc

SEQ ID NO: 3172 - DNA, 18 bp, Homo sapiens
tgctccgatcacctgcac

SEQ ID NO: 3173 - DNA, 18 bp, Homo sapiens
ctccgatcacctgcactg

SEQ ID NO: 3174 - DNA, 18 bp, Homo sapiens
ccgatcacctgcactgct

SEQ ID NO: 3175 - DNA, 18 bp, Homo sapiens
gatcacctgcactgctgc

SEQ ID NO: 3176 - DNA, 18 bp, Homo sapiens
tcacctgcactgctgccc

SEQ ID NO: 3177 - DNA, 18 bp, Homo sapiens
acctgcactgctgccccc

SEQ ID NO: 3178 - DNA, 18 bp, Homo sapiens
ctgcactgctgcccccaa

SEQ ID NO: 3179 - DNA, 18 bp, Homo sapiens
gcactgctgcccccaaga

SEQ ID NO: 3180 - DNA, 18 bp, Homo sapiens
actgctgcccccaagaca

SEQ ID NO: 3181 - DNA, 18 bp, Homo sapiens
tgctgcccccaagacact

SEQ ID NO: 3182 - DNA, 18 bp, Homo sapiens
ctgcccccaagacactgt

SEQ ID NO: 3183 - DNA, 18 bp, Homo sapiens
gcccccaagacactgtgt

SEQ ID NO: 3184 - DNA, 18 bp, Homo sapiens
ccccaagacactgtgtgt

SEQ ID NO: 3185 - DNA, 18 bp, Homo sapiens
ccaagacactgtgtgtga

SEQ ID NO: 3186 - DNA, 18 bp, Homo sapiens
aagacactgtgtgtgacc

SEQ ID NO: 3187 - DNA, 18 bp, Homo sapiens
gacactgtgtgtgacctg

SEQ ID NO: 3188 - DNA, 18 bp, Homo sapiens
cactgtgtgtgacctgat

SEQ ID NO: 3189 - DNA, 18 bp, Homo sapiens
ctgtgtgtgacctgatcc

SEQ ID NO: 3190 - DNA, 18 bp, Homo sapiens
gtgtgtgacctgatccag

SEQ ID NO: 3191 - DNA, 18 bp, Homo sapiens
gtgtgacctgatccagag

SEQ ID NO: 3192 - DNA, 18 bp, Homo sapiens
gtgacctgatccagagta

SEQ ID NO: 3193 - DNA, 18 bp, Homo sapiens
gacctgatccagagtaag

SEQ ID NO: 3194 - DNA, 18 bp, Homo sapiens
cctgatccagagtaagtg

SEQ ID NO: 3195 - DNA, 18 bp, Homo sapiens
tgatccagagtaagtgcc

SEQ ID NO: 3196 - DNA, 18 bp, Homo sapiens
atccagagtaagtgcctc

SEQ ID NO: 3197 - DNA, 18 bp, Homo sapiens
ccagagtaagtgcctctc

SEQ ID NO: 3198 - DNA, 18 bp, Homo sapiens
agagtaagtgcctctcca

SEQ ID NO: 3199 - DNA, 18 bp, Homo sapiens
agtaagtgcctctccaag

SEQ ID NO: 3200 - DNA, 18 bp, Homo sapiens
taagtgcctctccaagga

SEQ ID NO: 3201 - DNA, 18 bp, Homo sapiens
agtgcctctccaaggaga

SEQ ID NO: 3202 - DNA, 18 bp, Homo sapiens
tgcctctccaaggagaac

SEQ ID NO: 3203 - DNA, 18 bp, Homo sapiens
cctctccaaggagaacgc

SEQ ID NO: 3204 - DNA, 18 bp, Homo sapiens
tctccaaggagaacgcta

SEQ ID NO: 3205 - DNA, 18 bp, Homo sapiens
tccaaggagaacgctacc

SEQ ID NO: 3206 - DNA, 18 bp, Homo sapiens
caaggagaacgctaccac

SEQ ID NO: 3207 - DNA, 18 bp, Homo sapiens
aggagaacgctaccacgg

SEQ ID NO: 3208 - DNA, 18 bp, Homo sapiens
gagaacgctaccacggac

SEQ ID NO: 3209 - DNA, 18 bp, Homo sapiens
gaacgctaccacggacct

SEQ ID NO: 3210 - DNA, 18 bp, Homo sapiens
acgctaccacggacctcc

SEQ ID NO: 3211 - DNA, 18 bp, Homo sapiens
gctaccacggacctcctc

SEQ ID NO: 3212 - DNA, 18 bp, Homo sapiens
taccacggacctcctcac

SEQ ID NO: 3213 - DNA, 18 bp, Homo sapiens
ccacggacctcctcacta

SEQ ID NO: 3214 - DNA, 18 bp, Homo sapiens
acggacctcctcactaag

SEQ ID NO: 3215 - DNA, 18 bp, Homo sapiens
ggacctcctcactaagct

SEQ ID NO: 3216 - DNA, 18 bp, Homo sapiens
acctcctcactaagctgc

SEQ ID NO: 3217 - DNA, 18 bp, Homo sapiens
ctcctcactaagctgcct

SEQ ID NO: 3218 - DNA, 18 bp, Homo sapiens
cctcactaagctgcctgc

SEQ ID NO: 3219 - DNA, 18 bp, Homo sapiens
tcactaagctgcctgcgc

SEQ ID NO: 3220 - DNA, 18 bp, Homo sapiens
actaagctgcctgcgcac

SEQ ID NO: 3221 - DNA, 18 bp, Homo sapiens
taagctgcctgcgcacac

SEQ ID NO: 3222 - DNA, 18 bp, Homo sapiens
agctgcctgcgcacacag

SEQ ID NO: 3223 - DNA, 18 bp, Homo sapiens
taccagaggcagggtgca

SEQ ID NO: 3224 - DNA, 18 bp, Homo sapiens
ccagaggcagggtgcaga

SEQ ID NO: 3225 - DNA, 18 bp, Homo sapiens
agaggcagggtgcagata

SEQ ID NO: 3226 - DNA, 18 bp, Homo sapiens
aggcagggtgcagataca

SEQ ID NO: 3227 - DNA, 18 bp, Homo sapiens
gcagggtgcagatacagg

SEQ ID NO: 3228 - DNA, 18 bp, Homo sapiens
agggtgcagatacagggg

SEQ ID NO: 3229 - DNA, 18 bp, Homo sapiens
ggtgcagatacaggggtg

SEQ ID NO: 3230 - DNA, 18 bp, Homo sapiens
tgcagatacaggggtggg

SEQ ID NO: 3231 - DNA, 18 bp, Homo sapiens
cagatacaggggtggggc

SEQ ID NO: 3232 - DNA, 18 bp, Homo sapiens
gatacaggggtggggccc

SEQ ID NO: 3233 - DNA, 18 bp, Homo sapiens
tacaggggtggggccccc

SEQ ID NO: 3234 - DNA, 18 bp, Homo sapiens
caggggtggggccccctt

SEQ ID NO: 3235 - DNA, 18 bp, Homo sapiens
ggggtggggccccctttc

SEQ ID NO: 3236 - DNA, 18 bp, Homo sapiens
ggtggggccccctttcct

SEQ ID NO: 3237 - DNA, 18 bp, Homo sapiens
tggggccccctttcctcc

SEQ ID NO: 3238 - DNA, 18 bp, Homo sapiens
gggccccctttcctccct

SEQ ID NO: 3239 - DNA, 18 bp, Homo sapiens
gccccctttcctcccttt

SEQ ID NO: 3240 - DNA, 18 bp, Homo sapiens
cccctttcctccctttta

SEQ ID NO: 3241 - DNA, 18 bp, Homo sapiens
cctttcctcccttttagg

SEQ ID NO: 3242 - DNA, 18 bp, Homo sapiens
tttcctcccttttaggcc

SEQ ID NO: 3243 - DNA, 18 bp, Homo sapiens
tcctcccttttaggcctg

SEQ ID NO: 3244 - DNA, 18 bp, Homo sapiens
ctcccttttaggcctggc

SEQ ID NO: 3245 - DNA, 18 bp, Homo sapiens
cccttttaggcctggcct

SEQ ID NO: 3246 - DNA, 18 bp, Homo sapiens
cttttaggcctggcctta

SEQ ID NO: 3247 - DNA, 18 bp, Homo sapiens
tttaggcctggccttagg

SEQ ID NO: 3248 - DNA, 18 bp, Homo sapiens
taggcctggccttaggat

SEQ ID NO: 3249 - DNA, 18 bp, Homo sapiens
ggcctggccttaggatca

SEQ ID NO: 3250 - DNA, 18 bp, Homo sapiens
cctggccttaggatcact

SEQ ID NO: 3251 - DNA, 18 bp, Homo sapiens
tggccttaggatcactgc

SEQ ID NO: 3252 - DNA, 18 bp, Homo sapiens
gccttaggatcactgcaa

SEQ ID NO: 3253 - DNA, 18 bp, Homo sapiens
cttaggatcactgcaagg

SEQ ID NO: 3254 - DNA, 18 bp, Homo sapiens
taggatcactgcaaggtg

SEQ ID NO: 3255 - DNA, 18 bp, Homo sapiens
ggatcactgcaaggtggt

SEQ ID NO: 3256 - DNA, 18 bp, Homo sapiens
atcactgcaaggtggtgt

SEQ ID NO: 3257 - DNA, 18 bp, Homo sapiens
ctgagggtccccagtgcc

SEQ ID NO: 3258 - DNA, 18 bp, Homo sapiens
gagggtccccagtgccac

SEQ ID NO: 3259 - DNA, 18 bp, Homo sapiens
gggtccccagtgccactt

SEQ ID NO: 3260 - DNA, 18 bp, Homo sapiens
gtccccagtgccacttct

SEQ ID NO: 3261 - DNA, 18 bp, Homo sapiens
ccccagtgccacttctga

SEQ ID NO: 3262 - DNA, 18 bp, Homo sapiens
ccagtgccacttctgacc

SEQ ID NO: 3263 - DNA, 18 bp, Homo sapiens
agtgccacttctgacctg

SEQ ID NO: 3264 - DNA, 18 bp, Homo sapiens
tgccacttctgacctgtc

SEQ ID NO: 3265 - DNA, 18 bp, Homo sapiens
ccacttctgacctgtcct

SEQ ID NO: 3266 - DNA, 18 bp, Homo sapiens
acttctgacctgtcctct

SEQ ID NO: 3267 - DNA, 18 bp, Homo sapiens
ttctgacctgtcctctct

SEQ ID NO: 3268 - DNA, 18 bp, Homo sapiens
ctgacctgtcctctctgc

SEQ ID NO: 3269 - DNA, 18 bp, Homo sapiens
gacctgtcctctctgctt

SEQ ID NO: 3270 - DNA, 18 bp, Homo sapiens
cctgtcctctctgcttcc

SEQ ID NO: 3271 - DNA, 18 bp, Homo sapiens
tgtcctctctgcttccct

SEQ ID NO: 3272 - DNA, 18 bp, Homo sapiens
tcctctctgcttccctca

SEQ ID NO: 3273 - DNA, 18 bp, Homo sapiens
ctctctgcttccctcaca

SEQ ID NO: 3274 - DNA, 18 bp, Homo sapiens
tgggggatgtgaaatgtg

SEQ ID NO: 3275 - DNA, 18 bp, Homo sapiens
ggggatgtgaaatgtgac

SEQ ID NO: 3276 - DNA, 18 bp, Homo sapiens
ggatgtgaaatgtgacat

SEQ ID NO: 3277 - DNA, 18 bp, Homo sapiens
atgtgaaatgtgacatgg

SEQ ID NO: 3278 - DNA, 18 bp, Homo sapiens
gtgaaatgtgacatggag

SEQ ID NO: 3279 - DNA, 18 bp, Homo sapiens
gaaatgtgacatggaggt

SEQ ID NO: 3280 - DNA, 18 bp, Homo sapiens
aatgtgacatggaggtga

SEQ ID NO: 3281 - DNA, 18 bp, Homo sapiens
tgtgacatggaggtgagc

SEQ ID NO: 3282 - DNA, 18 bp, Homo sapiens
tgacatggaggtgagctg

SEQ ID NO: 3283 - DNA, 18 bp, Homo sapiens
acatggaggtgagctgcc

SEQ ID NO: 3284 - DNA, 18 bp, Homo sapiens
atggaggtgagctgccca

SEQ ID NO: 3285 - DNA, 18 bp, Homo sapiens
ggaggtgagctgcccaga

SEQ ID NO: 3286 - DNA, 18 bp, Homo sapiens
aggtgagctgcccagatg

SEQ ID NO: 3287 - DNA, 18 bp, Homo sapiens
gtgagctgcccagatggc

SEQ ID NO: 3288 - DNA, 18 bp, Homo sapiens
gagctgcccagatggcta

SEQ ID NO: 3289 - DNA, 18 bp, Homo sapiens
gctgcccagatggctata

SEQ ID NO: 3290 - DNA, 18 bp, Homo sapiens
tgcccagatggctatacc

SEQ ID NO: 3291 - DNA, 18 bp, Homo sapiens
cccagatggctatacctg

SEQ ID NO: 3292 - DNA, 18 bp, Homo sapiens
cagatggctatacctgct

SEQ ID NO: 3293 - DNA, 18 bp, Homo sapiens
gatggctatacctgctgc

SEQ ID NO: 3294 - DNA, 18 bp, Homo sapiens
tggctatacctgctgccg

SEQ ID NO: 3295 - DNA, 18 bp, Homo sapiens
gctatacctgctgccgtc

SEQ ID NO: 3296 - DNA, 18 bp, Homo sapiens
tatacctgctgccgtcta

SEQ ID NO: 3297 - DNA, 18 bp, Homo sapiens
tacctgctgccgtctaca

SEQ ID NO: 3298 - DNA, 18 bp, Homo sapiens
cctgctgccgtctacagt

SEQ ID NO: 3299 - DNA, 18 bp, Homo sapiens
tgctgccgtctacagtcg

SEQ ID NO: 3300 - DNA, 18 bp, Homo sapiens
ctgccgtctacagtcggg

SEQ ID NO: 3301 - DNA, 18 bp, Homo sapiens
gccgtctacagtcggggg

SEQ ID NO: 3302 - DNA, 18 bp, Homo sapiens
cgtctacagtcgggggcc

SEQ ID NO: 3303 - DNA, 18 bp, Homo sapiens
tctacagtcgggggcctg

SEQ ID NO: 3304 - DNA, 18 bp, Homo sapiens
tacagtcgggggcctggg

SEQ ID NO: 3305 - DNA, 18 bp, Homo sapiens
cagtcgggggcctggggc

SEQ ID NO: 3306 - DNA, 18 bp, Homo sapiens
gtcgggggcctggggctg

SEQ ID NO: 3307 - DNA, 18 bp, Homo sapiens
cgggggcctggggctgct

SEQ ID NO: 3308 - DNA, 18 bp, Homo sapiens
ggggcctggggctgctgc

SEQ ID NO: 3309 - DNA, 18 bp, Homo sapiens
ggcctggggctgctgccc

SEQ ID NO: 3310 - DNA, 18 bp, Homo sapiens
cctggggctgctgccctt

SEQ ID NO: 3311 - DNA, 18 bp, Homo sapiens
tggggctgctgccctttt

SEQ ID NO: 3312 - DNA, 18 bp, Homo sapiens
gggctgctgcccttttac

SEQ ID NO: 3313 - DNA, 18 bp, Homo sapiens
gctgctgcccttttaccc

SEQ ID NO: 3314 - DNA, 18 bp, Homo sapiens
tgctgcccttttacccag

SEQ ID NO: 3315 - DNA, 18 bp, Homo sapiens
ctgcccttttacccaggt

SEQ ID NO: 3316 - DNA, 18 bp, Homo sapiens
gcccttttacccaggtac

SEQ ID NO: 3317 - DNA, 18 bp, Homo sapiens
ccttttacccaggtaccc

SEQ ID NO: 3318 - DNA, 18 bp, Homo sapiens
ttttacccaggtacccag

SEQ ID NO: 3319 - DNA, 18 bp, Homo sapiens
ttacccaggtacccaggg

SEQ ID NO: 3320 - DNA, 18 bp, Homo sapiens
acccaggtacccaggggt

SEQ ID NO: 3321 - DNA, 18 bp, Homo sapiens
ccaggtacccaggggtgg

SEQ ID NO: 3322 - DNA, 18 bp, Homo sapiens
aggtacccaggggtggcg

SEQ ID NO: 3323 - DNA, 18 bp, Homo sapiens
gtacccaggggtggcggg

SEQ ID NO: 3324 - DNA, 18 bp, Homo sapiens
acccaggggtggcgggtg

SEQ ID NO: 3325 - DNA, 18 bp, Homo sapiens
ccaggggtggcgggtggg

SEQ ID NO: 3326 - DNA, 18 bp, Homo sapiens
aggggtggcgggtgggtg

SEQ ID NO: 3327 - DNA, 18 bp, Homo sapiens
gggtggcgggtgggtggg

SEQ ID NO: 3328 - DNA, 18 bp, Homo sapiens
gtggcgggtgggtgggct

SEQ ID NO: 3329 - DNA, 18 bp, Homo sapiens
ggcgggtgggtgggctga

SEQ ID NO: 3330 - DNA, 18 bp, Homo sapiens
cgggtgggtgggctgagc

SEQ ID NO: 3331 - DNA, 18 bp, Homo sapiens
ggtgggtgggctgagcac

SEQ ID NO: 3332 - DNA, 18 bp, Homo sapiens
tgggtgggctgagcacag

SEQ ID NO: 3333 - DNA, 18 bp, Homo sapiens
ggtgggctgagcacagtg

SEQ ID NO: 3334 - DNA, 18 bp, Homo sapiens
tgggctgagcacagtgtg

SEQ ID NO: 3335 - DNA, 18 bp, Homo sapiens
ggctgagcacagtgtggc

SEQ ID NO: 3336 - DNA, 18 bp, Homo sapiens
ctgagcacagtgtggcag

SEQ ID NO: 3337 - DNA, 18 bp, Homo sapiens
gagcacagtgtggcaggc

SEQ ID NO: 3338 - DNA, 18 bp, Homo sapiens
gcacagtgtggcaggcag

SEQ ID NO: 3339 - DNA, 18 bp, Homo sapiens
acagtgtggcaggcagcc

SEQ ID NO: 3340 - DNA, 18 bp, Homo sapiens
tggcaggcagccgggccc

SEQ ID NO: 3341 - DNA, 18 bp, Homo sapiens
gcaggcagccgggcccca

SEQ ID NO: 3342 - DNA, 18 bp, Homo sapiens
aggcagccgggccccagt

SEQ ID NO: 3343 - DNA, 18 bp, Homo sapiens
gcagccgggccccagtgc

SEQ ID NO: 3344 - DNA, 18 bp, Homo sapiens
agccgggccccagtgccc

SEQ ID NO: 3345 - DNA, 18 bp, Homo sapiens
ccgggccccagtgcccac

SEQ ID NO: 3346 - DNA, 18 bp, Homo sapiens
gggccccagtgcccacct

SEQ ID NO: 3347 - DNA, 18 bp, Homo sapiens
gccccagtgcccacctgc

SEQ ID NO: 3348 - DNA, 18 bp, Homo sapiens
cccagtgcccacctgccc

SEQ ID NO: 3349 - DNA, 18 bp, Homo sapiens
cagtgcccacctgccctt

SEQ ID NO: 3350 - DNA, 18 bp, Homo sapiens
gtgcccacctgcccttct

SEQ ID NO: 3351 - DNA, 18 bp, Homo sapiens
gcccacctgcccttcttc

SEQ ID NO: 3352 - DNA, 18 bp, Homo sapiens
ccacctgcccttcttcat

SEQ ID NO: 3353 - DNA, 18 bp, Homo sapiens
acctgcccttcttcatct

SEQ ID NO: 3354 - DNA, 18 bp, Homo sapiens
ctgcccttcttcatctgc

SEQ ID NO: 3355 - DNA, 18 bp, Homo sapiens
gcccttcttcatctgccc

SEQ ID NO: 3356 - DNA, 18 bp, Homo sapiens
ccttcttcatctgcccta

SEQ ID NO: 3357 - DNA, 18 bp, Homo sapiens
gctgtgtgctgtgaggac

SEQ ID NO: 3358 - DNA, 18 bp, Homo sapiens
tgtgtgctgtgaggacca

SEQ ID NO: 3359 - DNA, 18 bp, Homo sapiens
tgtgctgtgaggaccaca

SEQ ID NO: 3360 - DNA, 18 bp, Homo sapiens
tgctgtgaggaccacata

SEQ ID NO: 3361 - DNA, 18 bp, Homo sapiens
ctgtgaggaccacataca

SEQ ID NO: 3362 - DNA, 18 bp, Homo sapiens
gtgaggaccacatacact

SEQ ID NO: 3363 - DNA, 18 bp, Homo sapiens
gaggaccacatacactgc

SEQ ID NO: 3364 - DNA, 18 bp, Homo sapiens
ggaccacatacactgctg

SEQ ID NO: 3365 - DNA, 18 bp, Homo sapiens
accacatacactgctgtc

SEQ ID NO: 3366 - DNA, 18 bp, Homo sapiens
cacatacactgctgtccc

SEQ ID NO: 3367 - DNA, 18 bp, Homo sapiens
catacactgctgtcccgc

SEQ ID NO: 3368 - DNA, 18 bp, Homo sapiens
tacactgctgtcccgcgg

SEQ ID NO: 3369 - DNA, 18 bp, Homo sapiens
cactgctgtcccgcgggg

SEQ ID NO: 3370 - DNA, 18 bp, Homo sapiens
ctgctgtcccgcggggtt

SEQ ID NO: 3371 - DNA, 18 bp, Homo sapiens
gctgtcccgcggggttta

SEQ ID NO: 3372 - DNA, 18 bp, Homo sapiens
tgtcccgcggggtttacg

SEQ ID NO: 3373 - DNA, 18 bp, Homo sapiens
tcccgcggggtttacgtg

SEQ ID NO: 3374 - DNA, 18 bp, Homo sapiens
ccgcggggtttacgtgtg

SEQ ID NO: 3375 - DNA, 18 bp, Homo sapiens
gcggggtttacgtgtgac

SEQ ID NO: 3376 - DNA, 18 bp, Homo sapiens
ggggtttacgtgtgacac

SEQ ID NO: 3377 - DNA, 18 bp, Homo sapiens
ggtttacgtgtgacacgc

SEQ ID NO: 3378 - DNA, 18 bp, Homo sapiens
tttacgtgtgacacgcag

SEQ ID NO: 3379 - DNA, 18 bp, Homo sapiens
tacgtgtgacacgcagaa

SEQ ID NO: 3380 - DNA, 18 bp, Homo sapiens
cgtgtgacacgcagaagg

SEQ ID NO: 3381 - DNA, 18 bp, Homo sapiens
tgtgacacgcagaagggt

SEQ ID NO: 3382 - DNA, 18 bp, Homo sapiens
tgacacgcagaagggtac

SEQ ID NO: 3383 - DNA, 18 bp, Homo sapiens
acacgcagaagggtacct

SEQ ID NO: 3384 - DNA, 18 bp, Homo sapiens
acgcagaagggtacctgt

SEQ ID NO: 3385 - DNA, 18 bp, Homo sapiens
gcagaagggtacctgtga

SEQ ID NO: 3386 - DNA, 18 bp, Homo sapiens
agaagggtacctgtgaac

SEQ ID NO: 3387 - DNA, 18 bp, Homo sapiens
aagggtacctgtgaacag

SEQ ID NO: 3388 - DNA, 18 bp, Homo sapiens
gggtacctgtgaacaggg

SEQ ID NO: 3389 - DNA, 18 bp, Homo sapiens
gtacctgtgaacaggggc

SEQ ID NO: 3390 - DNA, 18 bp, Homo sapiens
acctgtgaacaggggccc

SEQ ID NO: 3391 - DNA, 18 bp, Homo sapiens
ctgtgaacaggggcccca

SEQ ID NO: 3392 - DNA, 18 bp, Homo sapiens
gtgaacaggggccccacc

SEQ ID NO: 3393 - DNA, 18 bp, Homo sapiens
gaacaggggccccaccag

SEQ ID NO: 3394 - DNA, 18 bp, Homo sapiens
acaggggccccaccaggt

SEQ ID NO: 3395 - DNA, 18 bp, Homo sapiens
aggggccccaccaggtgc

SEQ ID NO: 3396 - DNA, 18 bp, Homo sapiens
gggccccaccaggtgccc

SEQ ID NO: 3397 - DNA, 18 bp, Homo sapiens
gccccaccaggtgccctg

SEQ ID NO: 3398 - DNA, 18 bp, Homo sapiens
cccaccaggtgccctgga

SEQ ID NO: 3399 - DNA, 18 bp, Homo sapiens
caccaggtgccctggatg

SEQ ID NO: 3400 - DNA, 18 bp, Homo sapiens
ccaggtgccctggatgga

SEQ ID NO: 3401 - DNA, 18 bp, Homo sapiens
aggtgccctggatggaga

SEQ ID NO: 3402 - DNA, 18 bp, Homo sapiens
gtgccctggatggagaag

SEQ ID NO: 3403 - DNA, 18 bp, Homo sapiens
gccctggatggagaaggc

SEQ ID NO: 3404 - DNA, 18 bp, Homo sapiens
cctggatggagaaggccc

SEQ ID NO: 3405 - DNA, 18 bp, Homo sapiens
tggatggagaaggcccca

SEQ ID NO: 3406 - DNA, 18 bp, Homo sapiens
gatggagaaggccccagc

SEQ ID NO: 3407 - DNA, 18 bp, Homo sapiens
tggagaaggccccagctc

SEQ ID NO: 3408 - DNA, 18 bp, Homo sapiens
gagaaggccccagctcac

SEQ ID NO: 3409 - DNA, 18 bp, Homo sapiens
gaaggccccagctcacct

SEQ ID NO: 3410 - DNA, 18 bp, Homo sapiens
aggccccagctcacctca

SEQ ID NO: 3411 - DNA, 18 bp, Homo sapiens
gccccagctcacctcagc

SEQ ID NO: 3412 - DNA, 18 bp, Homo sapiens
cccagctcacctcagcct

SEQ ID NO: 3413 - DNA, 18 bp, Homo sapiens
cagctcacctcagcctgc

SEQ ID NO: 3414 - DNA, 18 bp, Homo sapiens
gctcacctcagcctgcca

SEQ ID NO: 3415 - DNA, 18 bp, Homo sapiens
tcacctcagcctgccaga

SEQ ID NO: 3416 - DNA, 18 bp, Homo sapiens
acctcagcctgccagacc

SEQ ID NO: 3417 - DNA, 18 bp, Homo sapiens
ctcagcctgccagaccca

SEQ ID NO: 3418 - DNA, 18 bp, Homo sapiens
cagcctgccagacccaca

SEQ ID NO: 3419 - DNA, 18 bp, Homo sapiens
gcctgccagacccacaag

SEQ ID NO: 3420 - DNA, 18 bp, Homo sapiens
ctgccagacccacaagcc

SEQ ID NO: 3421 - DNA, 18 bp, Homo sapiens
gccagacccacaagcctt

SEQ ID NO: 3422 - DNA, 18 bp, Homo sapiens
cagacccacaagccttga

SEQ ID NO: 3423 - DNA, 18 bp, Homo sapiens
gacccacaagccttgaag

SEQ ID NO: 3424 - DNA, 18 bp, Homo sapiens
cccacaagccttgaagag

SEQ ID NO: 3425 - DNA, 18 bp, Homo sapiens
cacaagccttgaagagag

SEQ ID NO: 3426 - DNA, 18 bp, Homo sapiens
caagccttgaagagagat

SEQ ID NO: 3427 - DNA, 18 bp, Homo sapiens
agccttgaagagagatgt

SEQ ID NO: 3428 - DNA, 18 bp, Homo sapiens
ccttgaagagagatgtcc

SEQ ID NO: 3429 - DNA, 18 bp, Homo sapiens
ttgaagagagatgtcccc

SEQ ID NO: 3430 - DNA, 18 bp, Homo sapiens
gaagagagatgtcccctg

SEQ ID NO: 3431 - DNA, 18 bp, Homo sapiens
agagagatgtcccctgtg

SEQ ID NO: 3432 - DNA, 18 bp, Homo sapiens
agagatgtcccctgtgat

SEQ ID NO: 3433 - DNA, 18 bp, Homo sapiens
agatgtcccctgtgataa

SEQ ID NO: 3434 - DNA, 18 bp, Homo sapiens
atgtcccctgtgataatg

SEQ ID NO: 3435 - DNA, 18 bp, Homo sapiens
gtcccctgtgataatgtc

SEQ ID NO: 3436 - DNA, 18 bp, Homo sapiens
cccctgtgataatgtcag

SEQ ID NO: 3437 - DNA, 18 bp, Homo sapiens
cctgtgataatgtcagca

SEQ ID NO: 3438 - DNA, 18 bp, Homo sapiens
tgtgataatgtcagcagc

SEQ ID NO: 3439 - DNA, 18 bp, Homo sapiens
tgataatgtcagcagctg

SEQ ID NO: 3440 - DNA, 18 bp, Homo sapiens
ataatgtcagcagctgtc

SEQ ID NO: 3441 - DNA, 18 bp, Homo sapiens
aatgtcagcagctgtccc

SEQ ID NO: 3442 - DNA, 18 bp, Homo sapiens
tgtcagcagctgtccctc

SEQ ID NO: 3443 - DNA, 18 bp, Homo sapiens
tcagcagctgtccctcct

SEQ ID NO: 3444 - DNA, 18 bp, Homo sapiens
agcagctgtccctcctcc

SEQ ID NO: 3445 - DNA, 18 bp, Homo sapiens
cagctgtccctcctccga

SEQ ID NO: 3446 - DNA, 18 bp, Homo sapiens
gctgtccctcctccgata

SEQ ID NO: 3447 - DNA, 18 bp, Homo sapiens
tgtccctcctccgatacc

SEQ ID NO: 3448 - DNA, 18 bp, Homo sapiens
tccctcctccgatacctg

SEQ ID NO: 3449 - DNA, 18 bp, Homo sapiens
cctcctccgatacctgct

SEQ ID NO: 3450 - DNA, 18 bp, Homo sapiens
tcctccgatacctgctgc

SEQ ID NO: 3451 - DNA, 18 bp, Homo sapiens
ctccgatacctgctgcca

SEQ ID NO: 3452 - DNA, 18 bp, Homo sapiens
ccgatacctgctgccaac

SEQ ID NO: 3453 - DNA, 18 bp, Homo sapiens
gatacctgctgccaactc

SEQ ID NO: 3454 - DNA, 18 bp, Homo sapiens
tacctgctgccaactcac

SEQ ID NO: 3455 - DNA, 18 bp, Homo sapiens
cctgctgccaactcacgt

SEQ ID NO: 3456 - DNA, 18 bp, Homo sapiens
tgctgccaactcacgtct

SEQ ID NO: 3457 - DNA, 18 bp, Homo sapiens
ctgccaactcacgtctgg

SEQ ID NO: 3458 - DNA, 18 bp, Homo sapiens
gccaactcacgtctgggg

SEQ ID NO: 3459 - DNA, 18 bp, Homo sapiens
caactcacgtctggggag

SEQ ID NO: 3460 - DNA, 18 bp, Homo sapiens
actcacgtctggggagtg

SEQ ID NO: 3461 - DNA, 18 bp, Homo sapiens
tcacgtctggggagtggg

SEQ ID NO: 3462 - DNA, 18 bp, Homo sapiens
acgtctggggagtggggc

SEQ ID NO: 3463 - DNA, 18 bp, Homo sapiens
gtctggggagtggggctg

SEQ ID NO: 3464 - DNA, 18 bp, Homo sapiens
ctggggagtggggctgct

SEQ ID NO: 3465 - DNA, 18 bp, Homo sapiens
ggggagtggggctgctgt

SEQ ID NO: 3466 - DNA, 18 bp, Homo sapiens
ggagtggggctgctgtcc

SEQ ID NO: 3467 - DNA, 18 bp, Homo sapiens
agtggggctgctgtccaa

SEQ ID NO: 3468 - DNA, 18 bp, Homo sapiens
tggggctgctgtccaatc

SEQ ID NO: 3469 - DNA, 18 bp, Homo sapiens
gggctgctgtccaatccc

SEQ ID NO: 3470 - DNA, 18 bp, Homo sapiens
gctgctgtccaatcccag

SEQ ID NO: 3471 - DNA, 18 bp, Homo sapiens
tgctgtccaatcccagag

SEQ ID NO: 3472 - DNA, 18 bp, Homo sapiens
tatatgggaggggacagc

SEQ ID NO: 3473 - DNA, 18 bp, Homo sapiens
tatgggaggggacagcat

SEQ ID NO: 3474 - DNA, 18 bp, Homo sapiens
tgggaggggacagcatct

SEQ ID NO: 3475 - DNA, 18 bp, Homo sapiens
ggaggggacagcatcttg

SEQ ID NO: 3476 - DNA, 18 bp, Homo sapiens
aggggacagcatcttggc

SEQ ID NO: 3477 - DNA, 18 bp, Homo sapiens
gggacagcatcttggcct

SEQ ID NO: 3478 - DNA, 18 bp, Homo sapiens
gacagcatcttggcctgg

SEQ ID NO: 3479 - DNA, 18 bp, Homo sapiens
cagcatcttggcctgggc

SEQ ID NO: 3480 - DNA, 18 bp, Homo sapiens
gcatcttggcctgggcag

SEQ ID NO: 3481 - DNA, 18 bp, Homo sapiens
atcttggcctgggcaggt

SEQ ID NO: 3482 - DNA, 18 bp, Homo sapiens
cttggcctgggcaggtgg

SEQ ID NO: 3483 - DNA, 18 bp, Homo sapiens
tggcctgggcaggtgggt

SEQ ID NO: 3484 - DNA, 18 bp, Homo sapiens
gcctgggcaggtgggtgg

SEQ ID NO: 3485 - DNA, 18 bp, Homo sapiens
ctgggcaggtgggtggcc

SEQ ID NO: 3486 - DNA, 18 bp, Homo sapiens
gggcaggtgggtggccaa

SEQ ID NO: 3487 - DNA, 18 bp, Homo sapiens
gcaggtgggtggccaagc

SEQ ID NO: 3488 - DNA, 18 bp, Homo sapiens
aggtgggtggccaagctc

SEQ ID NO: 3489 - DNA, 18 bp, Homo sapiens
gcgccccacatagtggct

SEQ ID NO: 3490 - DNA, 18 bp, Homo sapiens
gccccacatagtggctac

SEQ ID NO: 3491 - DNA, 18 bp, Homo sapiens
cccacatagtggctacct

SEQ ID NO: 3492 - DNA, 18 bp, Homo sapiens
cacatagtggctacctac

SEQ ID NO: 3493 - DNA, 18 bp, Homo sapiens
catagtggctacctacaa

SEQ ID NO: 3494 - DNA, 18 bp, Homo sapiens
tagtggctacctacaacg

SEQ ID NO: 3495 - DNA, 18 bp, Homo sapiens
gtggctacctacaacgcc

SEQ ID NO: 3496 - DNA, 18 bp, Homo sapiens
ggctacctacaacgccct

SEQ ID NO: 3497 - DNA, 18 bp, Homo sapiens
ctacctacaacgcccttt

SEQ ID NO: 3498 - DNA, 18 bp, Homo sapiens
acctacaacgccctttcc

SEQ ID NO: 3499 - DNA, 18 bp, Homo sapiens
ctacaacgccctttcctg

SEQ ID NO: 3500 - DNA, 18 bp, Homo sapiens
acaacgccctttcctgcc

SEQ ID NO: 3501 - DNA, 18 bp, Homo sapiens
aacgccctttcctgccca

SEQ ID NO: 3502 - DNA, 18 bp, Homo sapiens
cgccctttcctgcccacc

SEQ ID NO: 3503 - DNA, 18 bp, Homo sapiens
ccctttcctgcccacccc

SEQ ID NO: 3504 - DNA, 18 bp, Homo sapiens
ctttcctgcccacccccc

SEQ ID NO: 3505 - DNA, 18 bp, Homo sapiens
ttcctgcccaccccccag

SEQ ID NO: 3506 - DNA, 18 bp, Homo sapiens
ctgtctgctgctcggacc

SEQ ID NO: 3507 - DNA, 18 bp, Homo sapiens
gtctgctgctcggaccac

SEQ ID NO: 3508 - DNA, 18 bp, Homo sapiens
ctgctgctcggaccacca

SEQ ID NO: 3509 - DNA, 18 bp, Homo sapiens
gctgctcggaccaccagc

SEQ ID NO: 3510 - DNA, 18 bp, Homo sapiens
tgctcggaccaccagcac

SEQ ID NO: 3511 - DNA, 18 bp, Homo sapiens
ctcggaccaccagcactg

SEQ ID NO: 3512 - DNA, 18 bp, Homo sapiens
cggaccaccagcactgct

SEQ ID NO: 3513 - DNA, 18 bp, Homo sapiens
gaccaccagcactgctgc

SEQ ID NO: 3514 - DNA, 18 bp, Homo sapiens
ccaccagcactgctgccc

SEQ ID NO: 3515 - DNA, 18 bp, Homo sapiens
accagcactgctgccccc

SEQ ID NO: 3516 - DNA, 18 bp, Homo sapiens
cagcactgctgcccccag

SEQ ID NO: 3517 - DNA, 18 bp, Homo sapiens
gcactgctgcccccaggg

SEQ ID NO: 3518 - DNA, 18 bp, Homo sapiens
actgctgcccccagggct

SEQ ID NO: 3519 - DNA, 18 bp, Homo sapiens
tgctgcccccagggctac

SEQ ID NO: 3520 - DNA, 18 bp, Homo sapiens
ctgcccccagggctacac

SEQ ID NO: 3521 - DNA, 18 bp, Homo sapiens
gcccccagggctacacgt

SEQ ID NO: 3522 - DNA, 18 bp, Homo sapiens
ccccagggctacacgtgt

SEQ ID NO: 3523 - DNA, 18 bp, Homo sapiens
ccagggctacacgtgtgt

SEQ ID NO: 3524 - DNA, 18 bp, Homo sapiens
agggctacacgtgtgtag

SEQ ID NO: 3525 - DNA, 18 bp, Homo sapiens
ggctacacgtgtgtagct

SEQ ID NO: 3526 - DNA, 18 bp, Homo sapiens
ctacacgtgtgtagctga

SEQ ID NO: 3527 - DNA, 18 bp, Homo sapiens
acacgtgtgtagctgagg

SEQ ID NO: 3528 - DNA, 18 bp, Homo sapiens
acgtgtgtagctgagggg

SEQ ID NO: 3529 - DNA, 18 bp, Homo sapiens
gtgtgtagctgaggggca

SEQ ID NO: 3530 - DNA, 18 bp, Homo sapiens
gtgtagctgaggggcagt

SEQ ID NO: 3531 - DNA, 18 bp, Homo sapiens
gtagctgaggggcagtgt

SEQ ID NO: 3532 - DNA, 18 bp, Homo sapiens
agctgaggggcagtgtca

SEQ ID NO: 3533 - DNA, 18 bp, Homo sapiens
ctgaggggcagtgtcagc

SEQ ID NO: 3534 - DNA, 18 bp, Homo sapiens
gaggggcagtgtcagcga

SEQ ID NO: 3535 - DNA, 18 bp, Homo sapiens
ggggcagtgtcagcgagg

SEQ ID NO: 3536 - DNA, 18 bp, Homo sapiens
ggcagtgtcagcgaggaa

SEQ ID NO: 3537 - DNA, 18 bp, Homo sapiens
cagtgtcagcgaggaagc

SEQ ID NO: 3538 - DNA, 18 bp, Homo sapiens
gtgtcagcgaggaagcga

SEQ ID NO: 3539 - DNA, 18 bp, Homo sapiens
gtcagcgaggaagcgaga

SEQ ID NO: 3540 - DNA, 18 bp, Homo sapiens
cagcgaggaagcgagatc

SEQ ID NO: 3541 - DNA, 18 bp, Homo sapiens
gcgaggaagcgagatcgt

SEQ ID NO: 3542 - DNA, 18 bp, Homo sapiens
gaggaagcgagatcgtgg

SEQ ID NO: 3543 - DNA, 18 bp, Homo sapiens
ggaagcgagatcgtggct

SEQ ID NO: 3544 - DNA, 18 bp, Homo sapiens
aagcgagatcgtggctgg

SEQ ID NO: 3545 - DNA, 18 bp, Homo sapiens
gcgagatcgtggctggac

SEQ ID NO: 3546 - DNA, 18 bp, Homo sapiens
gagatcgtggctggactg

SEQ ID NO: 3547 - DNA, 18 bp, Homo sapiens
gatcgtggctggactgga

SEQ ID NO: 3548 - DNA, 18 bp, Homo sapiens
tcgtggctggactggaga

SEQ ID NO: 3549 - DNA, 18 bp, Homo sapiens
gtggctggactggagaag

SEQ ID NO: 3550 - DNA, 18 bp, Homo sapiens
ggctggactggagaagat

SEQ ID NO: 3551 - DNA, 18 bp, Homo sapiens
ctggactggagaagatgc

SEQ ID NO: 3552 - DNA, 18 bp, Homo sapiens
ggactggagaagatgcct

SEQ ID NO: 3553 - DNA, 18 bp, Homo sapiens
actggagaagatgcctgc

SEQ ID NO: 3554 - DNA, 18 bp, Homo sapiens
tggagaagatgcctgccc

SEQ ID NO: 3555 - DNA, 18 bp, Homo sapiens
gagaagatgcctgcccgc

SEQ ID NO: 3556 - DNA, 18 bp, Homo sapiens
gaagatgcctgcccgccg

SEQ ID NO: 3557 - DNA, 18 bp, Homo sapiens
agatgcctgcccgccggg

SEQ ID NO: 3558 - DNA, 18 bp, Homo sapiens
atgcctgcccgccgggct

SEQ ID NO: 3559 - DNA, 18 bp, Homo sapiens
gcctgcccgccgggcttc

SEQ ID NO: 3560 - DNA, 18 bp, Homo sapiens
ctgcccgccgggcttcct

SEQ ID NO: 3561 - DNA, 18 bp, Homo sapiens
gcccgccgggcttcctta

SEQ ID NO: 3562 - DNA, 18 bp, Homo sapiens
ccgccgggcttccttatc

SEQ ID NO: 3563 - DNA, 18 bp, Homo sapiens
gccgggcttccttatccc

SEQ ID NO: 3564 - DNA, 18 bp, Homo sapiens
cgggcttccttatcccac

SEQ ID NO: 3565 - DNA, 18 bp, Homo sapiens
ggcttccttatcccaccc

SEQ ID NO: 3566 - DNA, 18 bp, Homo sapiens
cttccttatcccacccca

SEQ ID NO: 3567 - DNA, 18 bp, Homo sapiens
tccttatcccaccccaga

SEQ ID NO: 3568 - DNA, 18 bp, Homo sapiens
cttatcccaccccagaga

SEQ ID NO: 3569 - DNA, 18 bp, Homo sapiens
tatcccaccccagagaca

SEQ ID NO: 3570 - DNA, 18 bp, Homo sapiens
tcccaccccagagacatc

SEQ ID NO: 3571 - DNA, 18 bp, Homo sapiens
ccaccccagagacatcgg

SEQ ID NO: 3572 - DNA, 18 bp, Homo sapiens
accccagagacatcggct

SEQ ID NO: 3573 - DNA, 18 bp, Homo sapiens
cccagagacatcggctgt

SEQ ID NO: 3574 - DNA, 18 bp, Homo sapiens
cagagacatcggctgtga

SEQ ID NO: 3575 - DNA, 18 bp, Homo sapiens
gagacatcggctgtgacc

SEQ ID NO: 3576 - DNA, 18 bp, Homo sapiens
gacatcggctgtgaccag

SEQ ID NO: 3577 - DNA, 18 bp, Homo sapiens
catcggctgtgaccagca

SEQ ID NO: 3578 - DNA, 18 bp, Homo sapiens
tcggctgtgaccagcaca

SEQ ID NO: 3579 - DNA, 18 bp, Homo sapiens
ggctgtgaccagcacacc

SEQ ID NO: 3580 - DNA, 18 bp, Homo sapiens
ctgtgaccagcacaccag

SEQ ID NO: 3581 - DNA, 18 bp, Homo sapiens
gtgaccagcacaccagct

SEQ ID NO: 3582 - DNA, 18 bp, Homo sapiens
gaccagcacaccagctgc

SEQ ID NO: 3583 - DNA, 18 bp, Homo sapiens
ccagcacaccagctgccc

SEQ ID NO: 3584 - DNA, 18 bp, Homo sapiens
agcacaccagctgcccgg

SEQ ID NO: 3585 - DNA, 18 bp, Homo sapiens
cacaccagctgcccggtg

SEQ ID NO: 3586 - DNA, 18 bp, Homo sapiens
caccagctgcccggtggg

SEQ ID NO: 3587 - DNA, 18 bp, Homo sapiens
ccagctgcccggtggggc

SEQ ID NO: 3588 - DNA, 18 bp, Homo sapiens
agctgcccggtggggcag

SEQ ID NO: 3589 - DNA, 18 bp, Homo sapiens
ctgcccggtggggcagac

SEQ ID NO: 3590 - DNA, 18 bp, Homo sapiens
gcccggtggggcagacct

SEQ ID NO: 3591 - DNA, 18 bp, Homo sapiens
ccggtggggcagacctgc

SEQ ID NO: 3592 - DNA, 18 bp, Homo sapiens
ggtggggcagacctgctg

SEQ ID NO: 3593 - DNA, 18 bp, Homo sapiens
tggggcagacctgctgcc

SEQ ID NO: 3594 - DNA, 18 bp, Homo sapiens
gggcagacctgctgcccg

SEQ ID NO: 3595 - DNA, 18 bp, Homo sapiens
gcagacctgctgcccgag

SEQ ID NO: 3596 - DNA, 18 bp, Homo sapiens
agacctgctgcccgagcc

SEQ ID NO: 3597 - DNA, 18 bp, Homo sapiens
acctgctgcccgagcctg

SEQ ID NO: 3598 - DNA, 18 bp, Homo sapiens
ctgctgcccgagcctggg

SEQ ID NO: 3599 - DNA, 18 bp, Homo sapiens
gctgcccgagcctgggtg

SEQ ID NO: 3600 - DNA, 18 bp, Homo sapiens
tgcccgagcctgggtggg

SEQ ID NO: 3601 - DNA, 18 bp, Homo sapiens
cccgagcctgggtgggag

SEQ ID NO: 3602 - DNA, 18 bp, Homo sapiens
cgagcctgggtgggagct

SEQ ID NO: 3603 - DNA, 18 bp, Homo sapiens
agcctgggtgggagctgg

SEQ ID NO: 3604 - DNA, 18 bp, Homo sapiens
cctgggtgggagctgggc

SEQ ID NO: 3605 - DNA, 18 bp, Homo sapiens
tgggtgggagctgggcct

SEQ ID NO: 3606 - DNA, 18 bp, Homo sapiens
ggtgggagctgggcctgc

SEQ ID NO: 3607 - DNA, 18 bp, Homo sapiens
tgggagctgggcctgctg

SEQ ID NO: 3608 - DNA, 18 bp, Homo sapiens
ggagctgggcctgctgcc

SEQ ID NO: 3609 - DNA, 18 bp, Homo sapiens
agctgggcctgctgccag

SEQ ID NO: 3610 - DNA, 18 bp, Homo sapiens
ctgggcctgctgccagtt

SEQ ID NO: 3611 - DNA, 18 bp, Homo sapiens
gggcctgctgccagttgc

SEQ ID NO: 3612 - DNA, 18 bp, Homo sapiens
gcctgctgccagttgccc

SEQ ID NO: 3613 - DNA, 18 bp, Homo sapiens
ctgctgccagttgcccca

SEQ ID NO: 3614 - DNA, 18 bp, Homo sapiens
gctgccagttgccccatg

SEQ ID NO: 3615 - DNA, 18 bp, Homo sapiens
tgccagttgccccatgtg

SEQ ID NO: 3616 - DNA, 18 bp, Homo sapiens
ccagttgccccatgtgag

SEQ ID NO: 3617 - DNA, 18 bp, Homo sapiens
agttgccccatgtgagtg

SEQ ID NO: 3618 - DNA, 18 bp, Homo sapiens
ttgccccatgtgagtgcc

SEQ ID NO: 3619 - DNA, 18 bp, Homo sapiens
gccccatgtgagtgcctc

SEQ ID NO: 3620 - DNA, 18 bp, Homo sapiens
cccatgtgagtgcctccc

SEQ ID NO: 3621 - DNA, 18 bp, Homo sapiens
catgtgagtgcctccctg

SEQ ID NO: 3622 - DNA, 18 bp, Homo sapiens
tgtgagtgcctccctgcc

SEQ ID NO: 3623 - DNA, 18 bp, Homo sapiens
tgagtgcctccctgcctg

SEQ ID NO: 3624 - DNA, 18 bp, Homo sapiens
agtgcctccctgcctgcc

SEQ ID NO: 3625 - DNA, 18 bp, Homo sapiens
tgcctccctgcctgcccc

SEQ ID NO: 3626 - DNA, 18 bp, Homo sapiens
cctccctgcctgcccctg

SEQ ID NO: 3627 - DNA, 18 bp, Homo sapiens
tccctgcctgcccctgga

SEQ ID NO: 3628 - DNA, 18 bp, Homo sapiens
cctgcctgcccctggata

SEQ ID NO: 3629 - DNA, 18 bp, Homo sapiens
tgcctgcccctggatagg

SEQ ID NO: 3630 - DNA, 18 bp, Homo sapiens
cctgcccctggatagggg

SEQ ID NO: 3631 - DNA, 18 bp, Homo sapiens
tgcccctggataggggag

SEQ ID NO: 3632 - DNA, 18 bp, Homo sapiens
cccctggataggggagct

SEQ ID NO: 3633 - DNA, 18 bp, Homo sapiens
cctggataggggagctaa

SEQ ID NO: 3634 - DNA, 18 bp, Homo sapiens
tggataggggagctaagc

SEQ ID NO: 3635 - DNA, 18 bp, Homo sapiens
gataggggagctaagccc

SEQ ID NO: 3636 - DNA, 18 bp, Homo sapiens
taggggagctaagcccag

SEQ ID NO: 3637 - DNA, 18 bp, Homo sapiens
ggggagctaagcccagtg

SEQ ID NO: 3638 - DNA, 18 bp, Homo sapiens
ggagctaagcccagtgag

SEQ ID NO: 3639 - DNA, 18 bp, Homo sapiens
agctaagcccagtgaggg

SEQ ID NO: 3640 - DNA, 18 bp, Homo sapiens
cagtgaggggacaggaac

SEQ ID NO: 3641 - DNA, 18 bp, Homo sapiens
gtgaggggacaggaacat

SEQ ID NO: 3642 - DNA, 18 bp, Homo sapiens
gaggggacaggaacataa

SEQ ID NO: 3643 - DNA, 18 bp, Homo sapiens
ggggacaggaacataatg

SEQ ID NO: 3644 - DNA, 18 bp, Homo sapiens
ggacaggaacataatgcc

SEQ ID NO: 3645 - DNA, 18 bp, Homo sapiens
acaggaacataatgccat

SEQ ID NO: 3646 - DNA, 18 bp, Homo sapiens
aggaacataatgccattc

SEQ ID NO: 3647 - DNA, 18 bp, Homo sapiens
gaacataatgccattctg

SEQ ID NO: 3648 - DNA, 18 bp, Homo sapiens
acataatgccattctgtg

SEQ ID NO: 3649 - DNA, 18 bp, Homo sapiens
ataatgccattctgtgct

SEQ ID NO: 3650 - DNA, 18 bp, Homo sapiens
aatgccattctgtgctcc

SEQ ID NO: 3651 - DNA, 18 bp, Homo sapiens
tgccattctgtgctccct

SEQ ID NO: 3652 - DNA, 18 bp, Homo sapiens
ccattctgtgctcccttc

SEQ ID NO: 3653 - DNA, 18 bp, Homo sapiens
attctgtgctcccttccc

SEQ ID NO: 3654 - DNA, 18 bp, Homo sapiens
tctgtgctcccttccccg

SEQ ID NO: 3655 - DNA, 18 bp, Homo sapiens
tgtgctcccttccccgcc

SEQ ID NO: 3656 - DNA, 18 bp, Homo sapiens
tgctcccttccccgccag

SEQ ID NO: 3657 - DNA, 18 bp, Homo sapiens
ctcccttccccgccaggc

SEQ ID NO: 3658 - DNA, 18 bp, Homo sapiens
cccttccccgccaggctg

SEQ ID NO: 3659 - DNA, 18 bp, Homo sapiens
cttccccgccaggctgtg

SEQ ID NO: 3660 - DNA, 18 bp, Homo sapiens
tccccgccaggctgtgtg

SEQ ID NO: 3661 - DNA, 18 bp, Homo sapiens
cccgccaggctgtgtgct

SEQ ID NO: 3662 - DNA, 18 bp, Homo sapiens
cgccaggctgtgtgctgc

SEQ ID NO: 3663 - DNA, 18 bp, Homo sapiens
ccaggctgtgtgctgcga

SEQ ID NO: 3664 - DNA, 18 bp, Homo sapiens
aggctgtgtgctgcgagg

SEQ ID NO: 3665 - DNA, 18 bp, Homo sapiens
gctgtgtgctgcgaggat

SEQ ID NO: 3666 - DNA, 18 bp, Homo sapiens
tgtgtgctgcgaggatcg

SEQ ID NO: 3667 - DNA, 18 bp, Homo sapiens
tgtgctgcgaggatcgcc

SEQ ID NO: 3668 - DNA, 18 bp, Homo sapiens
tgctgcgaggatcgccag

SEQ ID NO: 3669 - DNA, 18 bp, Homo sapiens
ctgcgaggatcgccagca

SEQ ID NO: 3670 - DNA, 18 bp, Homo sapiens
gcgaggatcgccagcact

SEQ ID NO: 3671 - DNA, 18 bp, Homo sapiens
gaggatcgccagcactgc

SEQ ID NO: 3672 - DNA, 18 bp, Homo sapiens
ggatcgccagcactgctg

SEQ ID NO: 3673 - DNA, 18 bp, Homo sapiens
atcgccagcactgctgcc

SEQ ID NO: 3674 - DNA, 18 bp, Homo sapiens
cgccagcactgctgcccg

SEQ ID NO: 3675 - DNA, 18 bp, Homo sapiens
ccagcactgctgcccggc

SEQ ID NO: 3676 - DNA, 18 bp, Homo sapiens
agcactgctgcccggctg

SEQ ID NO: 3677 - DNA, 18 bp, Homo sapiens
cactgctgcccggctggc

SEQ ID NO: 3678 - DNA, 18 bp, Homo sapiens
ctgctgcccggctggcta

SEQ ID NO: 3679 - DNA, 18 bp, Homo sapiens
gctgcccggctggctaca

SEQ ID NO: 3680 - DNA, 18 bp, Homo sapiens
tgcccggctggctacacc

SEQ ID NO: 3681 - DNA, 18 bp, Homo sapiens
cccggctggctacacctg

SEQ ID NO: 3682 - DNA, 18 bp, Homo sapiens
cggctggctacacctgca

SEQ ID NO: 3683 - DNA, 18 bp, Homo sapiens
gctggctacacctgcaac

SEQ ID NO: 3684 - DNA, 18 bp, Homo sapiens
tggctacacctgcaacgt

SEQ ID NO: 3685 - DNA, 18 bp, Homo sapiens
gctacacctgcaacgtga

SEQ ID NO: 3686 - DNA, 18 bp, Homo sapiens
tacacctgcaacgtgaag

SEQ ID NO: 3687 - DNA, 18 bp, Homo sapiens
cacctgcaacgtgaaggc

SEQ ID NO: 3688 - DNA, 18 bp, Homo sapiens
cctgcaacgtgaaggctc

SEQ ID NO: 3689 - DNA, 18 bp, Homo sapiens
tgcaacgtgaaggctcga

SEQ ID NO: 3690 - DNA, 18 bp, Homo sapiens
caacgtgaaggctcgatc

SEQ ID NO: 3691 - DNA, 18 bp, Homo sapiens
acgtgaaggctcgatcct

SEQ ID NO: 3692 - DNA, 18 bp, Homo sapiens
gtgaaggctcgatcctgc

SEQ ID NO: 3693 - DNA, 18 bp, Homo sapiens
gaaggctcgatcctgcga

SEQ ID NO: 3694 - DNA, 18 bp, Homo sapiens
aggctcgatcctgcgaga

SEQ ID NO: 3695 - DNA, 18 bp, Homo sapiens
gctcgatcctgcgagaag

SEQ ID NO: 3696 - DNA, 18 bp, Homo sapiens
tcgatcctgcgagaagga

SEQ ID NO: 3697 - DNA, 18 bp, Homo sapiens
gatcctgcgagaaggaag

SEQ ID NO: 3698 - DNA, 18 bp, Homo sapiens
tcctgcgagaaggaagtg

SEQ ID NO: 3699 - DNA, 18 bp, Homo sapiens
ctgcgagaaggaagtggt

SEQ ID NO: 3700 - DNA, 18 bp, Homo sapiens
gcgagaaggaagtggtct

SEQ ID NO: 3701 - DNA, 18 bp, Homo sapiens
gagaaggaagtggtctct

SEQ ID NO: 3702 - DNA, 18 bp, Homo sapiens
gaaggaagtggtctctgc

SEQ ID NO: 3703 - DNA, 18 bp, Homo sapiens
aggaagtggtctctgccc

SEQ ID NO: 3704 - DNA, 18 bp, Homo sapiens
gaagtggtctctgcccag

SEQ ID NO: 3705 - DNA, 18 bp, Homo sapiens
agtggtctctgcccagcc

SEQ ID NO: 3706 - DNA, 18 bp, Homo sapiens
tggtctctgcccagcctg

SEQ ID NO: 3707 - DNA, 18 bp, Homo sapiens
gtctctgcccagcctgcc

SEQ ID NO: 3708 - DNA, 18 bp, Homo sapiens
ctctgcccagcctgccac

SEQ ID NO: 3709 - DNA, 18 bp, Homo sapiens
ctgcccagcctgccacct

SEQ ID NO: 3710 - DNA, 18 bp, Homo sapiens
gcccagcctgccaccttc

SEQ ID NO: 3711 - DNA, 18 bp, Homo sapiens
ccagcctgccaccttcct

SEQ ID NO: 3712 - DNA, 18 bp, Homo sapiens
agcctgccaccttcctgg

SEQ ID NO: 3713 - DNA, 18 bp, Homo sapiens
cctgccaccttcctggcc

SEQ ID NO: 3714 - DNA, 18 bp, Homo sapiens
tgccaccttcctggcccg

SEQ ID NO: 3715 - DNA, 18 bp, Homo sapiens
ccaccttcctggcccgta

SEQ ID NO: 3716 - DNA, 18 bp, Homo sapiens
accttcctggcccgtagc

SEQ ID NO: 3717 - DNA, 18 bp, Homo sapiens
cttcctggcccgtagccc

SEQ ID NO: 3718 - DNA, 18 bp, Homo sapiens
tcctggcccgtagccctc

SEQ ID NO: 3719 - DNA, 18 bp, Homo sapiens
ctggcccgtagccctcac

SEQ ID NO: 3720 - DNA, 18 bp, Homo sapiens
ggcccgtagccctcacgt

SEQ ID NO: 3721 - DNA, 18 bp, Homo sapiens
cccgtagccctcacgtgg

SEQ ID NO: 3722 - DNA, 18 bp, Homo sapiens
cgtagccctcacgtgggt

SEQ ID NO: 3723 - DNA, 18 bp, Homo sapiens
tagccctcacgtgggtgt

SEQ ID NO: 3724 - DNA, 18 bp, Homo sapiens
gccctcacgtgggtgtga

SEQ ID NO: 3725 - DNA, 18 bp, Homo sapiens
cctcacgtgggtgtgaag

SEQ ID NO: 3726 - DNA, 18 bp, Homo sapiens
tcacgtgggtgtgaagga

SEQ ID NO: 3727 - DNA, 18 bp, Homo sapiens
acgtgggtgtgaaggacg

SEQ ID NO: 3728 - DNA, 18 bp, Homo sapiens
gtgggtgtgaaggacgtg

SEQ ID NO: 3729 - DNA, 18 bp, Homo sapiens
gggtgtgaaggacgtgga

SEQ ID NO: 3730 - DNA, 18 bp, Homo sapiens
gtgtgaaggacgtggagt

SEQ ID NO: 3731 - DNA, 18 bp, Homo sapiens
gtgaaggacgtggagtgt

SEQ ID NO: 3732 - DNA, 18 bp, Homo sapiens
gaaggacgtggagtgtgg

SEQ ID NO: 3733 - DNA, 18 bp, Homo sapiens
aggacgtggagtgtgggg

SEQ ID NO: 3734 - DNA, 18 bp, Homo sapiens
gacgtggagtgtggggaa

SEQ ID NO: 3735 - DNA, 18 bp, Homo sapiens
cgtggagtgtggggaagg

SEQ ID NO: 3736 - DNA, 18 bp, Homo sapiens
tggagtgtggggaaggac

SEQ ID NO: 3737 - DNA, 18 bp, Homo sapiens
gagtgtggggaaggacac

SEQ ID NO: 3738 - DNA, 18 bp, Homo sapiens
gtgtggggaaggacactt

SEQ ID NO: 3739 - DNA, 18 bp, Homo sapiens
gtggggaaggacacttct

SEQ ID NO: 3740 - DNA, 18 bp, Homo sapiens
ggggaaggacacttctgc

SEQ ID NO: 3741 - DNA, 18 bp, Homo sapiens
ggaaggacacttctgcca

SEQ ID NO: 3742 - DNA, 18 bp, Homo sapiens
aaggacacttctgccatg

SEQ ID NO: 3743 - DNA, 18 bp, Homo sapiens
ggacacttctgccatgat

SEQ ID NO: 3744 - DNA, 18 bp, Homo sapiens
acacttctgccatgataa

SEQ ID NO: 3745 - DNA, 18 bp, Homo sapiens
acttctgccatgataacc

SEQ ID NO: 3746 - DNA, 18 bp, Homo sapiens
ttctgccatgataaccag

SEQ ID NO: 3747 - DNA, 18 bp, Homo sapiens
ctgccatgataaccagac

SEQ ID NO: 3748 - DNA, 18 bp, Homo sapiens
gccatgataaccagacct

SEQ ID NO: 3749 - DNA, 18 bp, Homo sapiens
catgataaccagacctgc

SEQ ID NO: 3750 - DNA, 18 bp, Homo sapiens
tgataaccagacctgctg

SEQ ID NO: 3751 - DNA, 18 bp, Homo sapiens
ataaccagacctgctgcc

SEQ ID NO: 3752 - DNA, 18 bp, Homo sapiens
aaccagacctgctgccga

SEQ ID NO: 3753 - DNA, 18 bp, Homo sapiens
ccagacctgctgccgaga

SEQ ID NO: 3754 - DNA, 18 bp, Homo sapiens
agacctgctgccgagaca

SEQ ID NO: 3755 - DNA, 18 bp, Homo sapiens
acctgctgccgagacaac

SEQ ID NO: 3756 - DNA, 18 bp, Homo sapiens
ctgctgccgagacaaccg

SEQ ID NO: 3757 - DNA, 18 bp, Homo sapiens
gctgccgagacaaccgac

SEQ ID NO: 3758 - DNA, 18 bp, Homo sapiens
tgccgagacaaccgacag

SEQ ID NO: 3759 - DNA, 18 bp, Homo sapiens
ccgagacaaccgacaggg

SEQ ID NO: 3760 - DNA, 18 bp, Homo sapiens
gagacaaccgacagggct

SEQ ID NO: 3761 - DNA, 18 bp, Homo sapiens
gacaaccgacagggctgg

SEQ ID NO: 3762 - DNA, 18 bp, Homo sapiens
caaccgacagggctgggc

SEQ ID NO: 3763 - DNA, 18 bp, Homo sapiens
accgacagggctgggcct

SEQ ID NO: 3764 - DNA, 18 bp, Homo sapiens
cgacagggctgggcctgc

SEQ ID NO: 3765 - DNA, 18 bp, Homo sapiens
acagggctgggcctgctg

SEQ ID NO: 3766 - DNA, 18 bp, Homo sapiens
agggctgggcctgctgtc

SEQ ID NO: 3767 - DNA, 18 bp, Homo sapiens
ggctgggcctgctgtccc

SEQ ID NO: 3768 - DNA, 18 bp, Homo sapiens
ctgggcctgctgtcccta

SEQ ID NO: 3769 - DNA, 18 bp, Homo sapiens
gggcctgctgtccctacc

SEQ ID NO: 3770 - DNA, 18 bp, Homo sapiens
gcctgctgtccctaccgc

SEQ ID NO: 3771 - DNA, 18 bp, Homo sapiens
ctgctgtccctaccgcca

SEQ ID NO: 3772 - DNA, 18 bp, Homo sapiens
gtcagtgccaacccccat

SEQ ID NO: 3773 - DNA, 18 bp, Homo sapiens
cagtgccaacccccatcc

SEQ ID NO: 3774 - DNA, 18 bp, Homo sapiens
gtgccaacccccatcctg

SEQ ID NO: 3775 - DNA, 18 bp, Homo sapiens
gccaacccccatcctggg

SEQ ID NO: 3776 - DNA, 18 bp, Homo sapiens
caacccccatcctggggc

SEQ ID NO: 3777 - DNA, 18 bp, Homo sapiens
acccccatcctggggctg

SEQ ID NO: 3778 - DNA, 18 bp, Homo sapiens
ccccatcctggggctggg

SEQ ID NO: 3779 - DNA, 18 bp, Homo sapiens
ccatcctggggctgggta

SEQ ID NO: 3780 - DNA, 18 bp, Homo sapiens
atcctggggctgggtatg

SEQ ID NO: 3781 - DNA, 18 bp, Homo sapiens
cctggggctgggtatggc

SEQ ID NO: 3782 - DNA, 18 bp, Homo sapiens
tggggctgggtatggcca

SEQ ID NO: 3783 - DNA, 18 bp, Homo sapiens
gggctgggtatggccagg

SEQ ID NO: 3784 - DNA, 18 bp, Homo sapiens
gctgggtatggccaggga

SEQ ID NO: 3785 - DNA, 18 bp, Homo sapiens
tgggtatggccagggacc

SEQ ID NO: 3786 - DNA, 18 bp, Homo sapiens
ggtatggccagggaccag

SEQ ID NO: 3787 - DNA, 18 bp, Homo sapiens
tatggccagggaccaggt

SEQ ID NO: 3788 - DNA, 18 bp, Homo sapiens
tggccagggaccaggtcc

SEQ ID NO: 3789 - DNA, 18 bp, Homo sapiens
gggaccaggtcccacctc

SEQ ID NO: 3790 - DNA, 18 bp, Homo sapiens
gaccaggtcccacctcgt

SEQ ID NO: 3791 - DNA, 18 bp, Homo sapiens
ccaggtcccacctcgtcc

SEQ ID NO: 3792 - DNA, 18 bp, Homo sapiens
aggtcccacctcgtccaa

SEQ ID NO: 3793 - DNA, 18 bp, Homo sapiens
gtcccacctcgtccaacc

SEQ ID NO: 3794 - DNA, 18 bp, Homo sapiens
cccacctcgtccaaccct

SEQ ID NO: 3795 - DNA, 18 bp, Homo sapiens
cacctcgtccaaccctct

SEQ ID NO: 3796 - DNA, 18 bp, Homo sapiens
cctcgtccaaccctctcg

SEQ ID NO: 3797 - DNA, 18 bp, Homo sapiens
tcgtccaaccctctcgcc

SEQ ID NO: 3798 - DNA, 18 bp, Homo sapiens
gtccaaccctctcgcccc

SEQ ID NO: 3799 - DNA, 18 bp, Homo sapiens
ccaaccctctcgcccccc

SEQ ID NO: 3800 - DNA, 18 bp, Homo sapiens
aaccctctcgcccccctc

SEQ ID NO: 3801 - DNA, 18 bp, Homo sapiens
ccctctcgcccccctctg

SEQ ID NO: 3802 - DNA, 18 bp, Homo sapiens
ctctcgcccccctctgac

SEQ ID NO: 3803 - DNA, 18 bp, Homo sapiens
ctcgcccccctctgacca

SEQ ID NO: 3804 - DNA, 18 bp, Homo sapiens
cgcccccctctgaccatc

SEQ ID NO: 3805 - DNA, 18 bp, Homo sapiens
cccccctctgaccatcca

SEQ ID NO: 3806 - DNA, 18 bp, Homo sapiens
ggcgtctgttgtgctgat

SEQ ID NO: 3807 - DNA, 18 bp, Homo sapiens
cgtctgttgtgctgatcg

SEQ ID NO: 3808 - DNA, 18 bp, Homo sapiens
tctgttgtgctgatcggc

SEQ ID NO: 3809 - DNA, 18 bp, Homo sapiens
tgttgtgctgatcggcgc

SEQ ID NO: 3810 - DNA, 18 bp, Homo sapiens
ttgtgctgatcggcgcca

SEQ ID NO: 3811 - DNA, 18 bp, Homo sapiens
gtgctgatcggcgccact

SEQ ID NO: 3812 - DNA, 18 bp, Homo sapiens
gctgatcggcgccactgc

SEQ ID NO: 3813 - DNA, 18 bp, Homo sapiens
tgatcggcgccactgctg

SEQ ID NO: 3814 - DNA, 18 bp, Homo sapiens
atcggcgccactgctgtc

SEQ ID NO: 3815 - DNA, 18 bp, Homo sapiens
cggcgccactgctgtcct

SEQ ID NO: 3816 - DNA, 18 bp, Homo sapiens
gcgccactgctgtcctgc

SEQ ID NO: 3817 - DNA, 18 bp, Homo sapiens
gccactgctgtcctgctg

SEQ ID NO: 3818 - DNA, 18 bp, Homo sapiens
cactgctgtcctgctggc

SEQ ID NO: 3819 - DNA, 18 bp, Homo sapiens
ctgctgtcctgctggctt

SEQ ID NO: 3820 - DNA, 18 bp, Homo sapiens
gctgtcctgctggcttcc

SEQ ID NO: 3821 - DNA, 18 bp, Homo sapiens
tgtcctgctggcttccgc

SEQ ID NO: 3822 - DNA, 18 bp, Homo sapiens
tcctgctggcttccgctg

SEQ ID NO: 3823 - DNA, 18 bp, Homo sapiens
ctgctggcttccgctgcg

SEQ ID NO: 3824 - DNA, 18 bp, Homo sapiens
gctggcttccgctgcgca

SEQ ID NO: 3825 - DNA, 18 bp, Homo sapiens
tggcttccgctgcgcagc

SEQ ID NO: 3826 - DNA, 18 bp, Homo sapiens
gcttccgctgcgcagcca

SEQ ID NO: 3827 - DNA, 18 bp, Homo sapiens
ttccgctgcgcagccagg

SEQ ID NO: 3828 - DNA, 18 bp, Homo sapiens
ccgctgcgcagccagggg

SEQ ID NO: 3829 - DNA, 18 bp, Homo sapiens
gctgcgcagccaggggta

SEQ ID NO: 3830 - DNA, 18 bp, Homo sapiens
tgcgcagccaggggtacc

SEQ ID NO: 3831 - DNA, 18 bp, Homo sapiens
cgcagccaggggtaccaa

SEQ ID NO: 3832 - DNA, 18 bp, Homo sapiens
cagccaggggtaccaagt

SEQ ID NO: 3833 - DNA, 18 bp, Homo sapiens
gccaggggtaccaagtgt

SEQ ID NO: 3834 - DNA, 18 bp, Homo sapiens
caggggtaccaagtgttt

SEQ ID NO: 3835 - DNA, 18 bp, Homo sapiens
ggggtaccaagtgtttgc

SEQ ID NO: 3836 - DNA, 18 bp, Homo sapiens
ggtaccaagtgtttgcgc

SEQ ID NO: 3837 - DNA, 18 bp, Homo sapiens
taccaagtgtttgcgcag

SEQ ID NO: 3838 - DNA, 18 bp, Homo sapiens
ccaagtgtttgcgcaggg

SEQ ID NO: 3839 - DNA, 18 bp, Homo sapiens
aagtgtttgcgcagggag

SEQ ID NO: 3840 - DNA, 18 bp, Homo sapiens
gtgtttgcgcagggaggc

SEQ ID NO: 3841 - DNA, 18 bp, Homo sapiens
gtttgcgcagggaggccc

SEQ ID NO: 3842 - DNA, 18 bp, Homo sapiens
ttgcgcagggaggccccg

SEQ ID NO: 3843 - DNA, 18 bp, Homo sapiens
gcgcagggaggccccgcg

SEQ ID NO: 3844 - DNA, 18 bp, Homo sapiens
gcagggaggccccgcgct

SEQ ID NO: 3845 - DNA, 18 bp, Homo sapiens
agggaggccccgcgctgg

SEQ ID NO: 3846 - DNA, 18 bp, Homo sapiens
ggaggccccgcgctggga

SEQ ID NO: 3847 - DNA, 18 bp, Homo sapiens
aggccccgcgctgggacg

SEQ ID NO: 3848 - DNA, 18 bp, Homo sapiens
gccccgcgctgggacgcc

SEQ ID NO: 3849 - DNA, 18 bp, Homo sapiens
cccgcgctgggacgcccc

SEQ ID NO: 3850 - DNA, 18 bp, Homo sapiens
cgcgctgggacgcccctt

SEQ ID NO: 3851 - DNA, 18 bp, Homo sapiens
cgctgggacgcccctttg

SEQ ID NO: 3852 - DNA, 18 bp, Homo sapiens
ctgggacgcccctttgag

SEQ ID NO: 3853 - DNA, 18 bp, Homo sapiens
gggacgcccctttgaggg

SEQ ID NO: 3854 - DNA, 18 bp, Homo sapiens
gacgcccctttgagggac

SEQ ID NO: 3855 - DNA, 18 bp, Homo sapiens
cgcccctttgagggaccc

SEQ ID NO: 3856 - DNA, 18 bp, Homo sapiens
cccctttgagggacccag

SEQ ID NO: 3857 - DNA, 18 bp, Homo sapiens
cctttgagggacccagcc

SEQ ID NO: 3858 - DNA, 18 bp, Homo sapiens
tttgagggacccagcctt

SEQ ID NO: 3859 - DNA, 18 bp, Homo sapiens
tgagggacccagccttga

SEQ ID NO: 3860 - DNA, 18 bp, Homo sapiens
agggacccagccttgaga

SEQ ID NO: 3861 - DNA, 18 bp, Homo sapiens
ggacccagccttgagaca

SEQ ID NO: 3862 - DNA, 18 bp, Homo sapiens
acccagccttgagacagc

SEQ ID NO: 3863 - DNA, 18 bp, Homo sapiens
ccagccttgagacagctg

SEQ ID NO: 3864 - DNA, 18 bp, Homo sapiens
agccttgagacagctgct

SEQ ID NO: 3865 - DNA, 18 bp, Homo sapiens
ccttgagacagctgctgt

SEQ ID NO: 3866 - DNA, 18 bp, Homo sapiens
ttgagacagctgctgtga

SEQ ID NO: 3867 - DNA, 18 bp, Homo sapiens
gcggagtcggacgcaggc

SEQ ID NO: 3868 - DNA, 18 bp, Homo sapiens
ggagtcggacgcaggcag

SEQ ID NO: 3869 - DNA, 18 bp, Homo sapiens
agtcggacgcaggcagac

SEQ ID NO: 3870 - DNA, 18 bp, Homo sapiens
tcggacgcaggcagacca

SEQ ID NO: 3871 - DNA, 18 bp, Homo sapiens
ggacgcaggcagaccatg

SEQ ID NO: 3872 - DNA, 18 bp, Homo sapiens
acgcaggcagaccatgtg

SEQ ID NO: 3873 - DNA, 18 bp, Homo sapiens
ctgccgtccccttctgga

SEQ ID NO: 3874 - DNA, 18 bp, Homo sapiens
gccgtccccttctggaca

SEQ ID NO: 3875 - DNA, 18 bp, Homo sapiens
cgtccccttctggacaaa

SEQ ID NO: 3876 - DNA, 18 bp, Homo sapiens
tccccttctggacaaatg

SEQ ID NO: 3877 - DNA, 18 bp, Homo sapiens
cccttctggacaaatggc

SEQ ID NO: 3878 - DNA, 18 bp, Homo sapiens
cttctggacaaatggccc

SEQ ID NO: 3879 - DNA, 18 bp, Homo sapiens
tctggacaaatggcccac

SEQ ID NO: 3880 - DNA, 18 bp, Homo sapiens
tggacaaatggcccacaa

SEQ ID NO: 3881 - DNA, 18 bp, Homo sapiens
tgccccttcccagaggcc

SEQ ID NO: 3882 - DNA, 18 bp, Homo sapiens
ccccttcccagaggccgt

SEQ ID NO: 3883 - DNA, 18 bp, Homo sapiens
ccttcccagaggccgtgg

SEQ ID NO: 3884 - DNA, 18 bp, Homo sapiens
ttcccagaggccgtggca

SEQ ID NO: 3885 - DNA, 18 bp, Homo sapiens
cccagaggccgtggcatg

SEQ ID NO: 3886 - DNA, 18 bp, Homo sapiens
cagaggccgtggcatgcg

SEQ ID NO: 3887 - DNA, 18 bp, Homo sapiens
gaggccgtggcatgcggg

SEQ ID NO: 3888 - DNA, 18 bp, Homo sapiens
cttccaaagatcaggtaa

SEQ ID NO: 3889 - DNA, 18 bp, Homo sapiens
tccaaagatcaggtaaca

SEQ ID NO: 3890 - DNA, 18 bp, Homo sapiens
caaagatcaggtaacaac

SEQ ID NO: 3891 - DNA, 18 bp, Homo sapiens
aagatcaggtaacaactc

SEQ ID NO: 3892 - DNA, 18 bp, Homo sapiens
gatcaggtaacaactccg

SEQ ID NO: 3893 - DNA, 18 bp, Homo sapiens
tcaggtaacaactccgtg

SEQ ID NO: 3894 - DNA, 18 bp, Homo sapiens
tgccccatgccccaggct

SEQ ID NO: 3895 - DNA, 18 bp, Homo sapiens
ccccatgccccaggcttc

SEQ ID NO: 3896 - DNA, 18 bp, Homo sapiens
ccatgccccaggcttcct

SEQ ID NO: 3897 - DNA, 18 bp, Homo sapiens
atgccccaggcttcctgc

SEQ ID NO: 3898 - DNA, 18 bp, Homo sapiens
gccccaggcttcctgctg

SEQ ID NO: 3899 - DNA, 18 bp, Homo sapiens
cccaggcttcctgctgtg

SEQ ID NO: 3900 - DNA, 18 bp, Homo sapiens
gaggactaacagggcagt

SEQ ID NO: 3901 - DNA, 18 bp, Homo sapiens
ggactaacagggcagtgg

SEQ ID NO: 3902 - DNA, 18 bp, Homo sapiens
actaacagggcagtggcc

SEQ ID NO: 3903 - DNA, 18 bp, Homo sapiens
taacagggcagtggcctt

SEQ ID NO: 3904 - DNA, 18 bp, Homo sapiens
acagggcagtggccttgt

SEQ ID NO: 3905 - DNA, 18 bp, Homo sapiens
agggcagtggccttgtcc

SEQ ID NO: 3906 - DNA, 18 bp, Homo sapiens
ggcagtggccttgtccag

SEQ ID NO: 3907 - DNA, 18 bp, Homo sapiens
ctgcccaatgcccaacgc

SEQ ID NO: 3908 - DNA, 18 bp, Homo sapiens
gcccaatgcccaacgcca

SEQ ID NO: 3909 - DNA, 18 bp, Homo sapiens
ccaatgcccaacgccacc

SEQ ID NO: 3910 - DNA, 18 bp, Homo sapiens
aatgcccaacgccacctg

SEQ ID NO: 3911 - DNA, 18 bp, Homo sapiens
tgcccaacgccacctgct

SEQ ID NO: 3912 - DNA, 18 bp, Homo sapiens
cccaacgccacctgctgc

SEQ ID NO: 3913 - DNA, 18 bp, Homo sapiens
caacgccacctgctgctc

SEQ ID NO: 3914 - DNA, 18 bp, Homo sapiens
acgccacctgctgctccg

SEQ ID NO: 3915 - DNA, 18 bp, Homo sapiens
gctgcctgcgcacacagt

SEQ ID NO: 3916 - DNA, 18 bp, Homo sapiens
tgcctgcgcacacagtgg

SEQ ID NO: 3917 - DNA, 18 bp, Homo sapiens
cctgcgcacacagtgggg

SEQ ID NO: 3918 - DNA, 18 bp, Homo sapiens
tgcgcacacagtggggga

SEQ ID NO: 3919 - DNA, 18 bp, Homo sapiens
cgcacacagtgggggatg

SEQ ID NO: 3920 - DNA, 18 bp, Homo sapiens
cacacagtgggggatgtg

SEQ ID NO: 3921 - DNA, 18 bp, Homo sapiens
ctgcccttttacccaggc

SEQ ID NO: 3922 - DNA, 18 bp, Homo sapiens
gcccttttacccaggctg

SEQ ID NO: 3923 - DNA, 18 bp, Homo sapiens
ccttttacccaggctgtg

SEQ ID NO: 3924 - DNA, 18 bp, Homo sapiens
ttttacccaggctgtgtg

SEQ ID NO: 3925 - DNA, 18 bp, Homo sapiens
ttacccaggctgtgtgct

SEQ ID NO: 3926 - DNA, 18 bp, Homo sapiens
acccaggctgtgtgctgt

SEQ ID NO: 3927 - DNA, 18 bp, Homo sapiens
ccaggctgtgtgctgtga

SEQ ID NO: 3928 - DNA, 18 bp, Homo sapiens
ctgtccaatcccagaggc

SEQ ID NO: 3929 - DNA, 18 bp, Homo sapiens
gtccaatcccagaggctg

SEQ ID NO: 3930 - DNA, 18 bp, Homo sapiens
ccaatcccagaggctgtc

SEQ ID NO: 3931 - DNA, 18 bp, Homo sapiens
aatcccagaggctgtctg

SEQ ID NO: 3932 - DNA, 18 bp, Homo sapiens
tcccagaggctgtctgct

SEQ ID NO: 3933 - DNA, 18 bp, Homo sapiens
ccagaggctgtctgctgc

SEQ ID NO: 3934 - DNA, 18 bp, Homo sapiens
agaggctgtctgctgctc

SEQ ID NO: 3935 - DNA, 18 bp, Homo sapiens
ctgccagttgccccatgc

SEQ ID NO: 3936 - DNA, 18 bp, Homo sapiens
gccagttgccccatgctg

SEQ ID NO: 3937 - DNA, 18 bp, Homo sapiens
cagttgccccatgctgtg

SEQ ID NO: 3938 - DNA, 18 bp, Homo sapiens
gttgccccatgctgtgtg

SEQ ID NO: 3939 - DNA, 18 bp, Homo sapiens
tgccccatgctgtgtgct

SEQ ID NO: 3940 - DNA, 18 bp, Homo sapiens
ccccatgctgtgtgctgc

SEQ ID NO: 3941 - DNA, 18 bp, Homo sapiens
ccatgctgtgtgctgcga

SEQ ID NO: 3942 - DNA, 18 bp, Homo sapiens
atgctgtgtgctgcgagg

SEQ ID NO: 3943 - DNA, 18 bp, Homo sapiens
ctgtccctaccgccaggg

SEQ ID NO: 3944 - DNA, 18 bp, Homo sapiens
gtccctaccgccagggcg

SEQ ID NO: 3945 - DNA, 18 bp, Homo sapiens
ccctaccgccagggcgtc

SEQ ID NO: 3946 - DNA, 18 bp, Homo sapiens
ctaccgccagggcgtctg

SEQ ID NO: 3947 - DNA, 18 bp, Homo sapiens
accgccagggcgtctgtt

SEQ ID NO: 3948 - DNA, 18 bp, Homo sapiens
cgccagggcgtctgttgt

SEQ ID NO: 3949 - DNA, 8021 bp, Homo sapiens
attctccaatcacatgatccctagaaatggggtgtggggcgagaggaagcagggaggagagtgatttgagtagaaaagaaacacagcattccaggctggccccacctctatattgataagtagccaatgggagcgggtagccctgatccctggccaatggaaactgaggtaggcgggtcatcgcgctggggtctgtagtctgagcgctacccggttgctgctgcccaaggaccgcggagtcggacgcaggtaggagagcggccgcgcagacctctcgcctgctcctgcccaggggcccgccagggccatgtgagcttgaggttcccctggagtctcagccggagacaacagaagaaccgcttactgaaactccttgggggttctgatacactagggggagttttatgggaaagaggaagcagtaattgcagtgacgccccgttagaaggggctttctacctccccagcattcccccaaagcagggaccacaccattcttgacccagctccacccctgtcggtaggtgctggcttcttcccctctcctggtggtggtgggtggttcccgcggcggcctggagccggaggggcgcgcgaccctgggctgggagctccgagggcctgggaacgagacctgagaccttggcttctcgaaggtagtagggacttgggagtggtgactgaacctggtctggctcctccttacttcctcttgttgcgggtgggacgagctagcttccgcctctcccagccactttttcctgctcatttgcagctaggttggctccccttttgggaatttcctctccccttggcactcggagttggggggtgccacctagtggaagataacggagctagggtcttgaagaggctgctgtcccctctggctgttttggcggtgtagggtggcatgagagactgcgactcgcctcctcatccctgtttctgtatgcgagtgcttgtattcagtagaagcatacactatactccctcaatttagggtaaacaggaggggccacatgcacaggtaattcaccagggagccgaacactcctgtgcagacagactccccttcccagcaagccatggcagcggacagcctgctgagaacacccaggaagcaggcggtgccagctgcaggtgctttgcctgggagctgtggggctgaggagagggtccactgtccaggaccagtgaacttcatccttatctgtccaggaggtggcctcttggggatgctgagttaggggaggggcacttgaggaaagccaggtggagcagagaggatgtgagtgactgggtgggtgagatttcctgcccctccccccgcagtggtatccacacctagactcgtggggtaactgaggcacagacagagagcaacttctcaggccctcacagttggcaattctaggattaggacccaagtgcgattttcaggcagtccctgtaccctgtttctgttgtacctgttgcaccattcccaggcactgcccatcgtgccactagtgatatgaacccaggtccaatacgctctggggccatcaaagcctgacgtcaccatgacctgatgtgtgacgtgttataggtgtcccttggtatcttcacggaactggttccaggaccccaaaatctgtgggtgctcaagcccctgagataaaatggtgtaatatttgcatataacctatacatactttaaatcatttctagattacttatacctaatacaatggaaatgacatgtcggctgggcgtggtggctcatgcctgtaatcccaccactttgggaggccgtggcaggtggatcacctgaggtctggagtttgagaccagcctgaccaacatggtgaaacccccatctctactaaaaatacaaaaattagccaggtgtggtagcgcacacctataatcccacctacttgggaggctgaggcaggagaattgcttgaacctgggaggcggagttcgcagtaagctgagatcgcgccactgtactacagcctgggtgacagagcaggactccatctcaaaaaaaaaagagaaaaagaaaaagaaatgccatgtaaatagttgtgatcctgaattgtttagggaataataagaaagaactatctgtagatgttcagtatagatgcacccatcgtaagcctaactacattgtataactcagcaacgatgtaacattttcaggggtttttttgttttgttttttgagacagaatctcagtctcactctgtcacccaggctggagtatgttggcgtgatctctgctcactgcaacctccacctcctgggctcaagcgattctcctgcctcagcctcttgagtagctgggattgcaggtgtgcgctaccacgcatggctaatttttgtatttttaatagagatggggttttaccacgttggtcaggctggtcttgaactcctgaccttgggatccgcccacctgggcctcccaaagtgctgggattacaggcgttagccaccgcgcccaatatattttgatccctggttggatatggagggctgactgtacttaacatctctaagcttcagtttcctcctttaaaataaaggtgtggctgggtgtggtggttcaagcctgtaatcccagcacttagggaggctgaggtgggtggatcagctgaggtcaggagttcaagaccagcctgaccaatatggtgaaaccccctctctgctaaaaatacaaaaattagccaggcgtggtggcgagcgcctgtagtcccagctacttgcttgaacttgggaggcagaggttgcagtgagctgagatcgtgccactgaactcgagcatgggcaacagagcaagactgtctcaaaaaaaaaaaaaaaaagggggtgagcagacgtggtggcacgctcccacagtcccagctacttagtaggaggccaaggttggaggattgcttgatcccaggagtctgagtccagcctgggcaacatggcaatacctcatctctaaaaataaaataaaagtaaaggtattaattactactttggatggttgttgcaaagaaatatatataaaataatggagagtcttgtaactggctcccaagaggctcaacagacattactgtttttgcttcttcattatgagttacctctctggccaccccactgaactagctgggctagctgagcctgggagaagagttgtttaggaagtgagaggctgctctccacagagactcaaggctcagttcctcctggtgactcagatgggcagcccagtgggcacacgtggtctctctccacatgtggctgagtttcacttccagaatagatggagaggcaagggcagggtttagcatgcttgaggaatctcagagggccctggtggtgtgggggaccctcagaacacaggtgtctcaagggctgacccagcttctgtgtccttttctctgggtgaggaggggacattcatgggcagatggtgacctctggggaaggcagcccagactccactggccaccatatttcctttttcacaactttctcacccctgtggtttcccatgtcatcatgtggccgcttcccgcaaggccttagcggggtgcaggtatgaacatagtgtcaggcaaggaggcatctggaggggaaccctggcttttcctggggggactccctccctgcaccctagccctgtcctctcccatggctactgatgccttcccctcaccccagaggtggcccacatctgcacagatcagacccacaaaaatcacgtcttcctgactctcataagcctgcccagtgaggcccaggcattaggccatgtgctggggactcagacccacacatatacgcatgtcagcattcatgcttacaggtccgcacatgctggggcaagtgtcacacacggggcgctgtaggaagctgactctcagcccctgcagatttctgcctgcctggacagggaggtgttgagaaggctcaggcagtcctgggccaggaccttggcctggggctagggtactgagtgaccctagaatcaagggtggcgtgggcttaagcagttgccagacgttccttggtactttgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggtgagtgcccctcagcctaggcaagagctggcagcctgggttttcccaaagggtcatcttggattggccagaggaggacgccaggcacaagtctgtggtttatcattttccctgtctttctaggacaaatggcccacaacactgagcaggcatctgggtggcccctgccaggttgatgcccactgctctgccggccactcctgcatctttaccgtctcagggacttccagttgctgccccttcccagaggtgagcgtgccatcagcccagtggaggggcttaggtctgcatttatgcttttcctgcactctaccacctgcagataaaagggccctgccaatgcaggtttctctgtgttccacaggccgtggcatgcggggatggccatcactgctgcccacggggcttccactgcagtgcagacgggcgatcctgcttccaaagatcaggtgcagctggggtgtgggtgcagggcaggcagacgggcagcatgtggagtctggaacccaggagcccagctggcgggggcagccctgattcctgcccttgtgccctcattcatgtggcatctgtactaagcaacagccctgctgtggacagaggggcagcactggggataggagggtgcgggagaaagtgcaagactccaggtccaggcgttgtgggggtggggagaggtcgagctgggccggtctaataccaacccatggtcagtgggtgccccttccccatgccatcttgctgagggagggactggattgtgaggagggtgagttaggcctgcctaggagatcactgagccttagtgtcaccctcaaaccccagtagctgggcttgcaggccctggtgccaccagctccttgtgtgatgggggagtcaccttccctgagtgggctggtagtatcctgggtcatcttgtccacaggtaacaactccgtgggtgccatccagtgccctgatagtcagttcgaatgcccggacttctccacgtgctgtgttatggtcgatggctcctgggggtgctgccccatgccccaggtacaaatctgggggagatgggggtatgtggagggaagtgggggcagagttgggggccaggggcagggggtgaagacggagtcaggaccattttttctcaggcttcctgctgtgaagacagggtgcactgctgtccgcacggtgccttctgcgacctggttcacacccgctgcatcacacccacgggcacccaccccctggcaaagaagctccctgcccagaggactaacagggcaggtgaggaggtgggagagcatcaggccaggggctggggcggggcctcattgactccaagtgtaggaaaaagtttcctccatcctggctgcccctcacgtttgctcctcttccagtggccttgtccagctcggtcatgtgtccggacgcacggtcccggtgccctgatggttctacctgctgtgagctgcccagtgggaagtatggctgctgcccaatgcccaacgtgagtgaggggctggagccagcttggctgtgtgcccccagccacctggccctgacacgcaccttacaggggctctgtggcatggggctggctggctgcttgctgggagcctggctgatgcagggttcatgctaccccctagtgggggattggggcagtgccagccatcagcctggctgctccctgtgtgctactgagcctggaagtgacaaagacccacccctgtccccactcaggccacctgctgctccgatcacctgcactgctgcccccaagacactgtgtgtgacctgatccagagtaagtgcctctccaaggagaacgctaccacggacctcctcactaagctgcctgcgcacacaggtaccagaggcagggtgcagatacaggggtggggccccctttcctcccttttaggcctggccttaggatcactgcaaggtggtgtaagcggtaccctccatcttcaacacctggttccagctgtggagccggcaaagggttgatacccctgagggtccccagtgccacttctgacctgtcctctctgcttccctcacagtgggggatgtgaaatgtgacatggaggtgagctgcccagatggctatacctgctgccgtctacagtcgggggcctggggctgctgcccttttacccaggtacccaggggtggcgggtgggtgggctgagcacagtgtggcaggcagccgggccccagtgcccacctgcccttcttcatctgccctaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggtatatgggaggggacagcatcttggcctgggcaggtgggtggccaagctcctattgctttctgccctccgcatagcccataggtgatacccagctctgacagattcgtccccagctggaggtgctgtaagcaggagaggcgggctggagtaggtaggggctcggcactgcgccccacatagtggctacctacaacgccctttcctgcccaccccccaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgtgagtgcctccctgcctgcccctggataggggagctaagcccagtgaggggacaggaacataatgccattctgtgctcccttccccgccaggctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccaggtcagtgccaacccccatcctggggctgggtatggccagggaccaggtcccacctcgtccaaccctctcgcccccctctgaccatccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaa

The invention claimed is:

1. An antisense oligonucleotide progranulin agonist, wherein the antisense oligonucleotide is 12-40 nucleotides in length and comprises a contiguous nucleotide sequence of 12-40 nucleotides in length which are complementary to a human progranulin precursor-mRNA (pre-mRNA) or mature mRNA transcript wherein the contiguous nucleotide sequence is selected from:

SEQ ID NO: 105, SEQ ID NO: 106, SEQ ID NO:110, SEQ ID NO:113, SEQ ID NO:114, SEQ ID NO:119, SEQ ID NO:125, SEQ ID NO:228, SEQ ID NO:231, SEQ ID NO:235, SEQ ID NO:236, SEQ ID NO:237, SEQ ID NO:238, SEQ ID NO:241, SEQ ID NO:244, SEQ ID NO:246; SEQ ID NO:263, SEQ ID NO:267, SEQ ID NO:269, SEQ ID NO:270, SEQ ID NO:271, SEQ ID NO:272, SEQ ID NO:279, SEQ ID NO:280, SEQ ID NO:293, SEQ ID NO:300, SEQ ID NO:301, SEQ ID NO:305, SEQ ID NO:311, SEQ ID NO:312, or SEQ ID NO:327;

and further wherein the antisense oligonucleotide progranulin agonist comprises one or more modified nucleosides.

2. The antisense oligonucleotide progranulin agonist of claim 1, wherein the human progranulin mature mRNA transcript is SEQ ID NO:1.

3. The antisense oligonucleotide progranulin agonist of claim 1, wherein the human progranulin precursor-mRNA (pre-mRNA) is SEQ ID NO:3949.

4. The antisense oligonucleotide progranulin agonist according to claim 1, wherein the contiguous nucleotide sequence is the same length as the antisense oligonucleotide.

5. The antisense oligonucleotide progranulin agonist according to claim 1, wherein the contiguous nucleotide sequence is fully complementary to the human progranulin precursor-mRNA (pre-mRNA) or mature mRNA transcript.

6. The antisense oligonucleotide progranulin agonist according to claim 1, wherein the antisense oligonucleotide progranulin agonist is or comprises an antisense oligonucleotide mixmer or totalmer.

7. An antisense oligonucleotide progranulin agonist of SEQ ID NO 106 and having the structure:

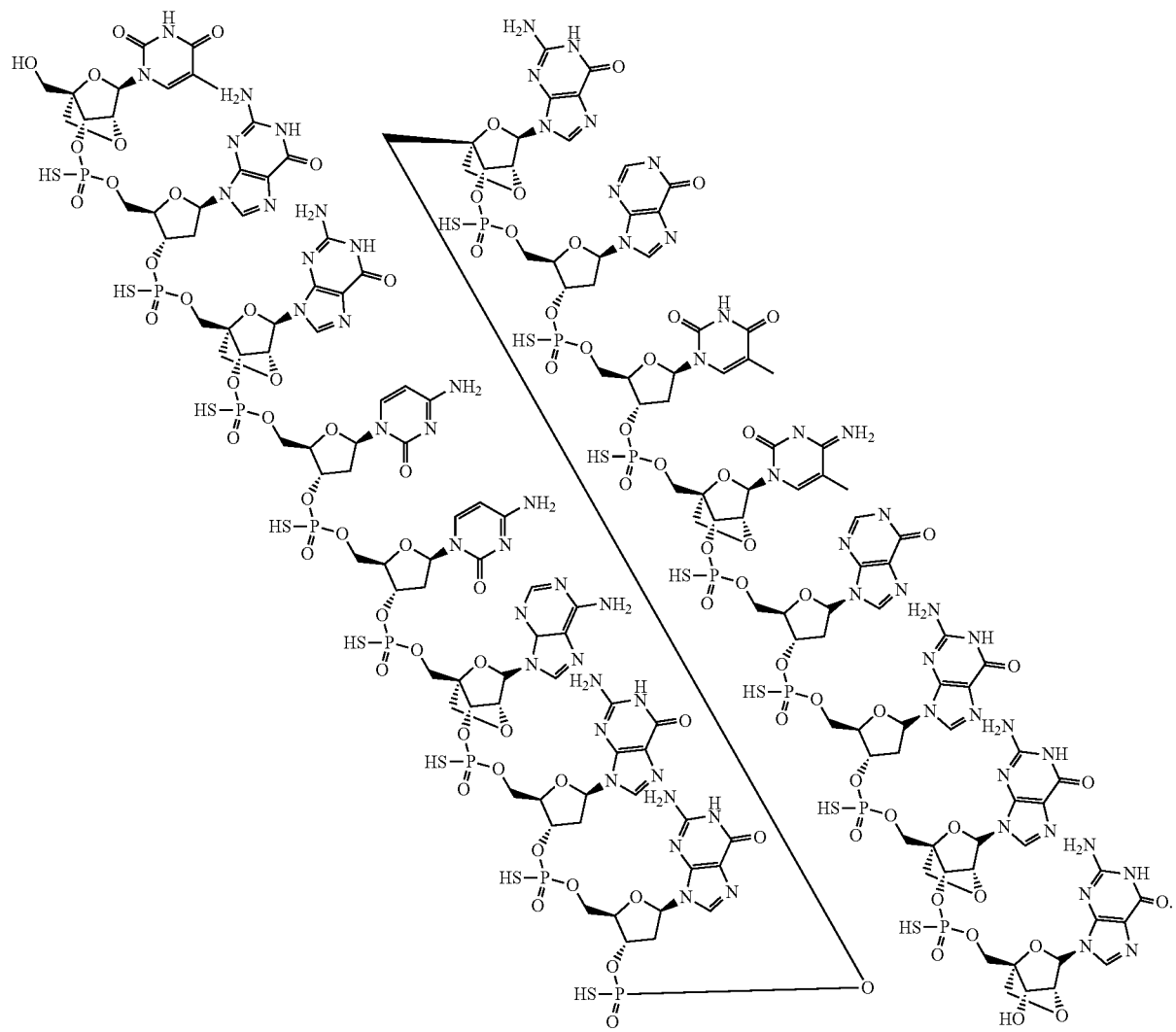

8. An antisense oligonucleotide progranulin agonist wherein the oligonucleotide is the oligonucleotide compound TgGccAggGatCagGG (SEQ ID NO: 106) wherein capital letters represent beta-D-oxy LNA nucleosides, lowercase letters represent DNA nucleosides, all LNA C are 5-methyl cytosine, and all internucleoside linkages are phosphorothioate internucleoside linkages.

9. An antisense oligonucleotide progranulin agonist according to claim 1 covalently attached to at least one conjugate moiety.

10. An antisense oligonucleotide progranulin agonist according to any one of claim 1 wherein the antisense oligonucleotide progranulin agonist is in the form of a pharmaceutically acceptable salt.

11. A pharmaceutical composition comprising the antisense oligonucleotide progranulin agonist according to claim 1 and a pharmaceutically acceptable diluent, solvent, carrier, salt and/or adjuvant.

12. An in vivo or in vitro method for enhancing the expression of progranulin in a cell which is expressing progranulin, said method comprising administering an antisense oligonucleotide progranulin agonist according to claim 1, in an effective amount to said cell.

13. An antisense oligonucleotide progranulin agonist according to claim 10 wherein the pharmaceutically acceptable salt is a sodium salt or potassium salt.

14. A pharmaceutical composition according to claim 11, wherein the pharmaceutical composition comprises an aqueous diluent or solvent.

15. A pharmaceutical composition according to claim 14 wherein the aqueous diluent or solvent is phosphate buffered saline.

* * * * *